US007678890B2

(12) United States Patent
Bosch et al.

(10) Patent No.: US 7,678,890 B2
(45) Date of Patent: Mar. 16, 2010

(54) COMPOSITIONS AND METHODS OF TREATING DISEASE WITH FGFR FUSION PROTEINS

(75) Inventors: Elizabeth Bosch, Cupertino, CA (US); Diane Hollenbaugh, Mountain View, CA (US); Ernestine Lee, Kensington, CA (US); Minmin Qin, Pleasanton, CA (US); Ali Sadra, San Mateo, CA (US)

(73) Assignee: Five Prime Therapeutics, Inc., San Francisco, CA (US)

( * ) Notice: Subject to any disclaimer, the term of this patent is extended or adjusted under 35 U.S.C. 154(b) by 0 days.

(21) Appl. No.: 11/791,889

(22) PCT Filed: Jul. 24, 2006

(86) PCT No.: PCT/US2006/028597

§ 371 (c)(1),
(2), (4) Date: May 30, 2007

(87) PCT Pub. No.: WO2007/014123

PCT Pub. Date: Feb. 1, 2007

(65) Prior Publication Data

US 2008/0171689 A1 Jul. 17, 2008

Related U.S. Application Data

(60) Provisional application No. 60/701,479, filed on Jul. 22, 2005, provisional application No. 60/729,401, filed on Oct. 21, 2005, provisional application No. 60/757,398, filed on Jan. 10, 2006, provisional application No. 60/800,005, filed on May 15, 2006.

(51) Int. Cl.
*A61K 38/00* (2006.01)
*A61K 38/16* (2006.01)
*A61K 39/00* (2006.01)

(52) U.S. Cl. .............. 530/387.3; 424/134.1; 424/185.1; 424/192.1; 514/12; 435/69.7

(58) Field of Classification Search ........................ None
See application file for complete search history.

(56) References Cited

U.S. PATENT DOCUMENTS

| 5,229,501 | A |   | 7/1993  | Keifer et al.    |          |
|-----------|---|---|---------|------------------|----------|
| 5,288,855 | A |   | 2/1994  | Bergonzoni et al.|          |
| 5,474,914 | A |   | 12/1995 | Spaete           |          |
| 5,486,462 | A | * | 1/1996  | Rutter et al.    | 435/69.1 |
| 5,707,632 | A |   | 1/1998  | Williams et al.  |          |
| 5,750,371 | A |   | 5/1998  | Senoo et al.     |          |
| 5,767,250 | A |   | 6/1998  | Spaete           |          |
| 5,863,888 | A |   | 1/1999  | Dionne et al.    |          |
| 6,255,454 | B1|   | 7/2001  | Keifer et al.    |          |
| 6,344,546 | B1|   | 2/2002  | Dionne et al.    |          |
| 6,350,593 | B1|   | 2/2002  | Williams et al.  |          |
| 6,355,440 | B1|   | 3/2002  | Williams et al.  |          |
| 6,384,191 | B1|   | 5/2002  | Williams et al.  |          |
| 6,517,872 | B1|   | 2/2003  | Yayon et al.     |          |
| 6,656,728 | B1|   | 12/2003 | Kavanaugh et al. |          |
| 6,844,168 | B1|   | 1/2005  | Keifer et al.    |          |
| 7,135,311 | B1|   | 11/2006 | David et al.     |          |
| 2004/0063910 | A1 | | 4/2004 | Kavanaugh et al.|          |
| 2004/0115768 | A1 | * | 6/2004 | Follstad        | 435/69.1 |
| 2005/0187150 | A1 | | 8/2005 | Mohammadi et al.|          |
| 2006/0286102 | A1 | | 12/2006| Jin et al.       |          |
| 2007/0248605 | A1 | | 10/2007| Hestir et al.    |          |

FOREIGN PATENT DOCUMENTS

| EP | 0 545 343 A1    | 6/1993  |
| WO | WO 91/00916     | 1/1991  |
| WO | WO 91/11459     | 8/1991  |
| WO | WO 2004/110487 A1 | 12/2004 |
| WO | WO 2005/113596 A2 | 12/2005 |
| WO | WO 2006/113277 A2 | 10/2006 |
| WO | WO 2007/059574 A1 | 5/2007  |
| WO | WO 2008/065543 A2 | 6/2008  |

OTHER PUBLICATIONS

PCT Notification of Transmittal of the International Search Report and the Written Opinion of the International Searching Authority, or the Declaration; International Search Report; and Written Opinion of the International Searching Authority, mailed Sep. 18, 2007, for International Application No. PCT/US2006/028597.

Ruta et al., "A novel protein tyrosine kinase gene whose expression is modulated during endothelial cell differentiation" Oncogene, 1988, vol. 3, pp. 9-15.

Couglin et al., "Acidic and basic fibroblast growth factors stimulate tyrosine kinase activity in vivo" J. Biol. Chem., vol. 263, No. 2, Jan. 15, 1988, pp. 988-993.

Feige et al., "Glycosylation of the basic fibroblast growth factor receptor" J. Biol. Chem., vol. 263, No. 28, Oct. 5, 1988, pp. 14023-14029.

Lee et al., "Purification and complementary DNA cloning of a receptor for basic fibroblast growth factor" Science, vol. 245, No. 4913, Jul. 7, 1989, pp. 57-60.

(Continued)

*Primary Examiner*—Lorraine Spector
*Assistant Examiner*—Elly-Gerald Stoica
(74) *Attorney, Agent, or Firm*—Finnegan, Henderson, Farabow, Garrett & Dunner LLP

(57) ABSTRACT

The invention provides FGFR fusion proteins, methods of making them, and methods of using them to treat proliferative disorders, including cancers and disorders of angiogenesis. The FGFR fusion molecules can be made in CHO cells and may comprise deletion mutations in the extracellular domains of the FGFRs which improve their stability. These fusion proteins inhibit the growth and viability of cancer cells in vitro and in vivo. The combination of the relatively high affinity of these receptors for their ligand FGFs and the demonstrated ability of these decoy receptors to inhibit tumor growth is an indication of the clinical value of the compositions and methods provided herein.

3 Claims, 44 Drawing Sheets

OTHER PUBLICATIONS

Pasquale et al., "Identification of a developmentally regulated protein-tyrosine kinase by using anti-phosphotyrosine antibodies to screen a cDNA expression library" Proc. Natl. Acad. Sci., vol. 86, Jul. 1989, pp. 5449-5453.

Johnson et al., "Diverse forms of a receptor for acidic and basic fibroblast growth factors" Molecular and Cellular Biology, vol. 10, No. 9, Sep. 1990, pp. 4728-4736.

Johnson et al, "The human fibroblast growth factor receptor genes: a common structural arrangement underlies the mechanisms for generating receptor forms that differ in their third immunoglobulin domain" Molecular and Cellular Biology, vol. 11, No. 9, Sept. 1991, pp. 4627-4634.

Ueno et al., "A truncated form of fibroblast growth factor receptor 1 inhibits signal transduction by multiple types of fibroblast growth factor receptor" J. Biol. Chem., vol. 267, No. 3, Jan. 25, 1992, pp. 1470-1476.

Cheon et al., "High-affinity binding sites for related fibroblast growth factor ligands reside within different receptor immunoglobulin-like domains" Proc. Natl. Acad. Sci, vol. 91, Feb. 1994, pp. 989-993.

Li et al., "Cell transformation by fibroblast growth factors can be suppressed by truncated fibroblast growth factor receptors" Molecular and Cellular Biology, vol. 14, No. 11, Nov. 1994, pp. 7660-7669.

Williams et al., "Activation of the FGF receptor underlies neurite outgrowth stimulated by L1, N-CAM, and N-Cadherin" Neuron, vol. 13, Sep. 1994, pp. 583-594.

Wang et al., "Purification and characterization of a functional soluble fibroblast growth factor receptor 1" Biochem. Biophys. Res. Comm., vol. 203, No. 3, Sep. 30, 1994, pp. 1781-1788.

Hanneken et al., "Soluble forms of the high-affinity fibroblast growth factor receptor in human vitreous fluid" Investigative Opthalmology & Visual Science, vol. 36, No. 6, May 1995, pp. 1192-1196.

Liuzzo et al, "Human leukemia cell lines bind basic fibroblast growth factor (FGF) on FGF receptors and heparin sulfates: downmodulation of FGF receptors by phorbol ester" Blood, vol. 87, No. 1, Jan. 1, 1996, pp. 245-255.

Ornitz et al., "Receptor specificity of the fibroblast growth factor family" J. Biol. Chem., vol. 271, No. 25, Jun. 21, 1996, pp. 15292-15297.

Celli et al., "Soluble dominant-negative receptor uncovers essential roles for fibroblast growth factors in multi-organ induction and patterning" the EMBO Journal, vol. 17, No. 6, Mar. 16, 1998, pp. 1642-1655.

Ye et al., "FGF and Shh signals control dopaminergic and serotonergic cell fate in the anterior neural plate" Cell, vol. 93, May 29, 1998, pp. 755-766.

Ballinger et al., "Semirational design of a potent, artificial agonist of fibroblast growth factor receptors" Nature Biotechnology, vol. 17, Dec. 1999, pp. 1199-1204.

Shamim et al., "Sequential roles for Fgf4, En1 and Fgf8 in specification and regionalization of the midbrain" Development, vol. 126, Feb. 1999, pp. 945-959.

Compagni et al., "Fibroblast growth factors are required for efficient tumor angiogenesis" Cancer Research, vol. 60, Dec. 15, 2000, pp. 7163-7169.

Auguste et al., "Inhibition of fibroblast growth factor/fibroblast growth factor receptor activity in glioma cells impedes tumor growth by both angiogenesis-dependent and -independent mechanisms" Cancer Research, vol. 61, Feb. 15, 2001, pp. 1717-1726.

Tuominen et al., "Expression and glycosylation studies of human FGF Receptor 4" Protein Expression and Purification, vol. 21, Mar. 2001, pp. 275-285.

Ogawa et al., "Anti-tumor angiogenesis therapy using soluble receptors: enhanced inhibition of tumor growth when soluble fibroblast growth factor receptor-1 is used with soluble vascular endothelial growth factor receptor" Cancer Gene Therapy, vol. 9, Aug. 2002, pp. 633-640.

Akimoto et al., "Fibroblast growth factor 2 promotes microvessel formation from mouse embryonic aorta" Am. J. Physiol. Cell Physiol., vol. 284, No. 2, 2003, pp. C371-C377.

St. Bernard et al., "Fibroblast growth factor receptors as molecular targets in thyroid carcinoma" Endocrinology, vol. 146, No. 3, 2005, pp. 1145-1153.

Gowardhan et al., "Evaluation of the fibroblast growth factor system as a potential target for therapy in human prostate cancer" British Journal of Cancer, vol. 92, Jan. 18, 2005, pp. 320-327.

Ezzat et al., "A soluble dominant negative fibroblast growth factor receptor 4 isoform in human MCF-7 breast cancer cells" Biochem. Biophys. Res. Comm., vol. 287, No. 1, 2001, pp. 60-65.

Kleeff et al., "Adenovirus-mediated transfer of a truncated fibroblast growth factor (FGF) type I receptor blocks FGF-2 signaling in multiple pancreatic cancer cell lines" Pancreas, vol. 28, No. 1, Jan. 2004, pp. 25-30.

Wagner et al., "Suppression of fibroblast growth factor receptor signaling inhibits pancreatic cancer growth in vitro and in vivo" Gastroenterology, vol. 114, Apr. 1998, pp. 798-807.

Tucker et al., "A novel approach for inhibiting growth factor signalling in murine tooth development" Eur. J. Oral Sci., vol. 106 (suppl, 1), 1998, pp. 122-125.

Kan et al., "Divalent cations and heparin/heparan sulfate cooperate to control assembly and activity of the fibroblast growth factor receptor complex" J. Biol. Chem., vol. 271, No. 42, Oct. 18, 1996, pp. 26143-26148.

Grossman et al., "Expression of human thyrotropin in cell lines with different glycosylation patterns combined with mutagenesis of specific glycosylation sites" J. Biol. Chem., vol. 270, No. 49, Dec. 8, 1995, pp. 29378-29385.

Kaufman et al., "Characterization of ligand binding to immobilized biotinylated extracellular domains of three growth factor receptors" Anal. Biochem., vol. 211, No. 2, Jun. 1993, pp. 261-266.

Otto et al., "Sialylated complex-type $N$-glycans enhance the signaling activity of soluble intercellular adhesion molecule-1 in mouse astrocytes" J. Biol. Chem., vol. 279, No. 34, Aug. 20, 2004, pp. 35201-35209.

Smith et al., "The asparagine-linked oligosaccharides on tissue factor pathway inhibitor terminate with $SO_4$-4GalNAc$\beta$1,4GlcNAc$\beta$1,2Man$\alpha$" J. Biol. Chem., vol. 267, No. 27, Sep. 25, 1992, pp. 19140-19146.

Roghani et al., "Heparin increases the affinity of basic fibroblast growth factor for its receptor but is not required for binding" J. Biol. Chem., vol. 269, No. 6, Feb. 11, 1994, pp. 3976-3984.

Van Den Nieuwenhof et al., "Recombinant glycodelin carrying the same type of glycan structures as contraceptive glycodelin-A can be produced in human kidney 293 cells but not in Chinese hamster ovary cells" Eur. J. Biochem., vol. 267, Aug. 2000, pp. 4753-4762.

Baker et al., "Metabolic control of recombinant protein $N$-glycan processing in NSO and CHO cells" Biotechnology and Bioengineering, vol. 73, No. 3, May 5, 2001, pp. 188-202.

Chellaiah et al., "Mapping ligand binding domains in chimeric fibroblast growth factor receptor molecules" J. Biol. Chem., vol. 274, No. 49, Dec. 3, 1999, pp. 34785-34794.

Kwabi-Addo et al., "The role of fibroblast growth factors and their receptors in prostate cancer" Endocrine-Related Cancer, vol. 11, No. 4, Dec. 2004, pp. 709-724.

Mansukhani et al., "A murine fibroblast growth factor (FGF) receptor expressed in CHO cells is activated by basic FGF and Kaposi FGF" Proc. Natl. Acad. Sci., vol. 87, Jun. 1990, pp. 4378-4382.

Harding et al., "Role of VEGF, PDGF and FGF in glioblastoma progression as determined by soluble decoy receptor expression in preclinical models" Cell Genesys, Inc., Abstract No. 3030, presented at the AACR Annual Meeting, Apr. 16-20, 2005, 1 page.

Werner et al., "Differential splicing in the extracellular region of fibroblast growth factor receptor 1 generates receptor variants with different ligand-binding specificities" Molecular and Cellular Biology, vol. 12, No. 1, Jan. 1992, pp. 82-88.

Plotnikov et al., "Crystal structures of two FGF-FGFR complexes reveal the determinants of ligand-receptor specificity" Cell, vol. 101, May 12, 2000, pp. 413-424.

Plotnikov et al., "Structural basis for FGF receptor dimerization and activation" Cell, vol. 98, Sep. 3, 1999, pp. 641-650.

Ornitz et al., "Heparin is required for cell-free binding of basic fibroblast growth factor to a soluble receptor and for mitogenesis in whole cells" Molecular and Cellular Biology, vol. 12, Jan. 1992, pp. 240-247.

Olsen et al., "Insights into the molecular basis for fibroblast growth factor receptor autoinhibition and ligand-binding promiscuity" Proc. Natl. Acad. Sci., vol. 101, No. 4 Jan. 27, 2004, pp. 935-940.

Anderson et al., "Apert syndrome mutations in fibroblast growth factor receptor 2 exhibit increased affinity for FGF ligand" Human Molecular Genetics, vol. 7, No. 9, 1998, pp. 1475-1483.

Hanneken et al., "Identification of soluble forms of the fibroblast growth factor receptor in blood" Proc. Natl. Acad. Sci., vol. 91, Sep. 1994, pp. 9170-9174.

Hanneken et al., "Structural characterization of the circulating soluble FGF receptors reveals multiple isoforms generated by secretion and ectodomain shedding" FEBS Letters, vol. 489, 2001, pp. 176-181.

Lopez et al., "A novel type I fibroblast growth factor receptor activates mitogenic signaling in the absence of detectable tyrosine phosphorylation of FRS2" J. Biol. Chem., vol. 275, No. 21, May 26, 2000, pp. 15933-15939.

Powell et al., "Fibroblast growth factor receptors 1 and 2 interact differently with heparin/heparin sulfate" J. Biol. Chem., vol. 277, No. 32, Aug. 9, 2002, pp. 28554-28563.

Trueb et al., "Characterization of FGFRL1, a novel fibroblast growth factor (FGF) receptor preferentially expressed in skeletal tissues" J. Biol. Chem., vol. 278, No. 36, Sep. 5, 2003, pp. 33857-33865.

Wang et al., "A natural kinase-deficient variant of fibroblast growth factor receptor 1" Biochemistry, Vo. 35, 1996, pp. 10134-10142.

Lundin et al., "Selectively desulfated heparin inhibits fibroblast growth factor-induced mitogenicity and angiogenesis" J. Biol. Chem., vol. 275, No. 32, Aug. 11, 2000, pp. 24653-24660.

Tomlinson et al., "Alternative splicing of fibroblast growth factor receptor 3 produces a secreted isoform that inhibits fibroblast growth factor-induced proliferation and is repressed in urothelial carcinoma cell lines" Cancer Research, vol. 65, No. 22, Nov. 15, 2005, pp. 10441-10449.

Guillonneau et al., "Fibroblast growth factor (FGF) soluble receptor 1 acts as a natural inhibitor of FGF2 neurotrophic activity during retinal degeneration" Molecular Biology of the Cell, vol. 9, Oct. 1998, pp. 2785-2802.

Bernard et al., "Fibroblast growth factor receptors as molecular targets in thyroid carcinoma" Endocrinology, vol. 10, Nov. 24, 2004, pp. 1-26 and 6 pgs. figures.

Keifer et al., "Molecular cloning of a human basic fibroblast growth factor receptor cDNA and expression of a biologically active extracellular domain in a baculoviurs system" Growth Factors, vol. 5, 1991, pp. 115-127.

Patent Cooperation Treaty International Preliminary Report on Patentability, issued Jan. 22, 2008, in International Application No. PCT/US2006/028597.

Application for Entry into the European Phase with amended claims filed after receipt of European Search Report, filed Feb. 22, 2008, in European Application No. 06 800 260.9.

Amended claims filed after receipt of European Search Report, filed Mar. 17, 2008, in European Application No. 06 800 260.9.

Examination Report, mailed Jun. 10, 2008, in European Application No. 06 800 260.9.

Reply to Examination Report, filed Aug. 13, 2008, in European Application No. 06 800 260.9.

Examination Report, mailed Sep. 8, 2008, in European Application No. 06 800 260.9.

Reply to Examination Report, filed Dec. 17, 2008, in European Application No. 06 800 260.9.

Result of consultation by telephone of Dec. 17, 2008, with applicant/representative, mailed Dec. 30, 2008, in European Application No. 06 800 260.9.

Examination Report, mailed Jan. 22, 2009, in European Application No. 06 800 260.9.

Reply to Examination Report, filed Mar. 6, 2009, in European Application No. 06 800 260.9.

Reply to Examination Report, filed May 22, 2009, in European Application No. 06 800 260.9.

Levi, et al., "Matrix metalloproteinase 2 releases active soluble ectodomain of fibroblast growth factor receptor 1", XP-002413740, Proc. Natl. Acad. Sci., USA, vol. 93, pp. 7069-7074, (Jul. 1996).

Powers, et al., "Fribroblast growth factors, their receptors and signaling", XP-002165147, Endocrine-Related Cancer, 7, pp. 165-197, (2000).

* cited by examiner

FIG. 1A

Ig III domain of FGFRs

```
FGFR3 IIIb  LKHVEVNGSKVGPDGTPYVTVLKSWISESVEADVRLR-LANVSERDGGEYLCRATNFIGV  346
FGFR3 IIIc  LKHVEVNGSKVGPDGTPYVTVLKSWISESVEADVRLR-LANVSERDGGEYLCRATNFIGF  347
FGFR1 IIIb  LKHIEVNGSKIGPDNLPYVQILKHSGINSSD--AEVLTLFNVTEAQSGEYVCKVSNYIGE  347
FGFR1 IIIc  LKHIEVNGSKIGPDNLPYVQILKTAGVNTTDKELEVLSLHNVTFEDAGEYTCLAGNSIGL  347
FGFR2 IIIb  IKHVEKNGSKYGPDGLPYLKVLKHSGINSSNAEVLALFN--VTEADAGEYICKVSNYIGQ  348
FGFR2 IIIc  IKHVEKNGSKYGPDGLPYLKVLKAAGVNTTDKEIEVLYIRNVTFEDAGEYTCLAGNSIGL  350
FGFR4      LKHIVINGSFGADGFPYVQVLKTADINSSE--VEVLYLRNVSAEDAGEYTCLAGNSIGL  341
```

```
FGFR3 IIIb  AEKAFWLSVHGPRAAEE  ELVEADEAGSVYAG
FGFR3 IIIc  SHHSAWLVLP---AEEE  ELVEADEAGSVYAG
FGFR1 IIIb  ANQSAWLTVTRPVAKAL  EERPAVMTSPLYLE
FGFR1 IIIc  SHHSAWLTVL---EALE  ERPAVMTSPLYLE
FGFR2 IIIb  ANQSAWLTVLPK-QQAP  GREKEITASPDYLE
FGFR2 IIIc  SFHSAWLTVLP---APG  REKEITASPDYLE
FGFR4      SYQSAWLTVLP---EED  PTWTAAAPEARYTD
```

Fc portion of an antibody

Truncations for FGFR1-IIIc-Fc

R1Mut5  R1Mut4  R1Mut3  R1Mut1
         R1Mut2

| Cell line | Malignancy origin | Sensitivity to FGFR1 IIIc Fc |
|---|---|---|
| MDA-MB-435 | breast | - |
| MCF7 | breast | - |
| MDA-MB-231 | breast | - |
| T47D | breast | - |
| A549 | lung | + |
| NCI-H522 | lung | + |
| NCI-H460 | lung | - |
| NCI-H23 | lung | - |
| NCI-H226 | lung | + |
| U118 | brain | + |
| U87114 | brain | - |
| U251 | brain | + |
| SF268 | brain | + |
| WT11 | brain | + |
| DU145 | prostate | - |
| PC-3 | prostate | - |
| COLO 205 | colon | - |
| Caki-1 | kidney | + |
| SK-MEL-2 | skin | - |
| SK-OV-3 | ovary | - |

FIG. 18

| Cell Lines | FGFR1-IIIb-Fc | FGFR1-IIIc-Fc | FGFR2-IIIb-Fc | FGFR2-IIIc-Fc | FGFR3-IIIb-Fc | FGFR3-IIIc-Fc | FGFR4-Fc | Human IgG |
|---|---|---|---|---|---|---|---|---|
| | | | | % Inhibition | | | | |
| A549 | 38 | 42 | 31 | 40 | 18 | 34 | 26 | 12 |
| Caki-1 | 51 | 52 | 41 | 49 | 26 | 49 | 40 | 18 |
| SF268 | 2 | 18 | 11 | 26 | 6 | 22 | 2 | -4 |
| T47D | 9 | 15 | 10 | 12 | 11 | 7 | 3 | 10 |
| U118 | 21 | 36 | 13 | 33 | 14 | 21 | 26 | 12 |
| U251 | 29 | 44 | 26 | 53 | 18 | 42 | 21 | 3 |

FIG. 21

COMPOSITIONS AND METHODS OF TREATING DISEASE WITH FGFR FUSION PROTEINS

RELATED APPLICATIONS

The invention relates to applications 60/701,479, filed Jul. 22, 2005; 60/729,401, filed Oct. 21, 2005; 60/757,398, filed Jan. 10, 2006; and 60/800,005, filed May 15, 2006, all of which are incorporated by reference in their entireties.

TECHNICAL FIELD

The present invention relates to fusion molecules comprising an extracellular domain of a fibroblast growth factor receptor (FGFR). It relates to polypeptide and polynucleotide sequences, vectors, host cells, compositions, kits, and animals comprising FGFR fusion proteins. The invention also relates to methods of making and using FGFR fusion molecules and variants and fragments thereof to diagnose, prevent, determine the prognosis for, and treat proliferative diseases, including cancer and disorders of angiogenesis.

BACKGROUND ART

Fibroblast growth factors (FGFs) and their receptors (FGFR) are a highly conserved group of proteins with instrumental roles in angiogenesis, vasculogenesis, and wound healing, as well as tissue patterning and limb formation in embryonic development. FGFs and FGFRs affect cell migration, proliferation, and survival, providing wide-ranging impacts on health and disease.

The FGFR family comprises four major types of receptors, FGFR1, FGFR2, FGFR3, and FGFR4. These receptors are transmembrane proteins having an extracellular domain, a transmembrane domain, and an intracytoplasmic domain. Each of the extracellular domains contains either two or three immunoglobulin (Ig) domains. Some FGFRs exist in different isoforms which differ in specific segments of the molecule, such as FGFR-IIIb and FGFR1-IIIc, which differ in the C-terminal region of the third Ig domain. Transmembrane FGFRs are monomeric tyrosine kinase receptors, activated by dimerization, which occurs at the cell surface in a complex of FGFR dimers, FGF ligands, and heparin glycans or proteoglycans. Extracellular FGFR activation by FGF ligand binding to an FGFR initiates a cascade of signaling events inside the cell, beginning with the receptor tyrosine kinase activity.

To date, there are 23 known FGFs, each with the capacity to bind one or more FGFRs (Zhang et al., *J. Biol. Chem.* 281:15, 694-15,700 (2006)). Several FGFs can bind to and activate each of one or more FGFRs, often with large differences, for order of magnitude differences in their affinities for the different FGFRs. Many FGFs bind their respective FGFRs with very high affinities, some in the picomolar range. Heparin is required for the binding of FGFs to FGFRs under some circumstances (Ornitz et al., *Mol. Cell. Biol.* 12:240 (1992)). For example, the mitogenic response to FGF-2 (also known as basic FGF (bFGF)) mediated by FGFR1 has been shown to depend on the presence of heparin (Ornitz et al., *Mol. Cell. Biol.* 12:240 (1992)).

Previously proposed therapeutic approaches using specific antibodies to block FGF function do not address the issue of redundancy within the FGF family in activating multiple FGFRs, since cancers or other proliferative cells may express upregulated levels of more than one FGF or FGFR. Antisense oligonucleotide or related siRNA therapies have potential problems with specificity, serum half-life, and intracellular delivery. Gene transfer therapies, including those using adenovirus, have raised issues of patient safety and a number of clinical gene therapy studies have been halted due to patient death. Small molecule tyrosine kinase inhibitor therapies suffer from issues of target specificity, toxicity, and manifestations of drug resistance. To date, no drug which targets an FGFR signaling pathway has been approved for treating any human disease.

SUMMARY

The invention provides an FGFR fusion protein comprising a first polypeptide that comprises an extracellular domain of an FGFR polypeptide and a fusion partner, wherein the extracellular domain comprises a C-terminus, wherein the C-terminus comprises a variant of a wildtype FGFR extracellular domain C-terminus, wherein the variant comprises a deletion of 1-22 amino acid residues present in a wildtype FGFR1, FGFR2, FGFR3, or FGFR4 extracellular domain C-terminus, and wherein the FGFR fusion protein binds at least one FGF ligand or a biologically active fragment thereof. In an embodiment, the deletion is C-terminal to a valine residue situated at the C-terminus of the IgIII domain and commonly aligned among the wildtype FGFR1, FGFR2, FGFR3, and FGFR4 extracellular domain C-termini. In an embodiment, the FGFR fusion protein is less susceptible to cleavage.

The invention also provides an FGFR fusion protein comprising a first polypeptide that comprises an extracellular domain of an FGFR polypeptide and a fusion partner; wherein the extracellular domain comprises a C-terminus, wherein the C-terminus comprises a variant of a wildtype FGFR extracellular domain C-terminus, wherein the variant comprises at least one point mutation compared to a wildtype FGFR1, FGFR2, FGFR3, or FGFR4 extracellular domain C-terminus; and wherein the point mutation renders the FGFR fusion protein less susceptible to cleavage.

Any of these FGFR fusion proteins may comprise an FGFR1 polypeptide, an FGFR2 polypeptide, an FGFR3 polypeptide, and/or an FGFR4 polypeptide. Any of these FGFR fusion proteins may comprise an Fc polypeptide.

In an embodiment, the extracellular domain of the FGFR fusion protein comprises an amino acid sequence of any of SEQ ID NO: 100, SEQ ID NO: 97 to SEQ ID NO.: 99, SEQ ID NO.: 101 to SEQ ID NO: 122, SEQ ID NO: 127 to SEQ ID NO: 132, SEQ ID NO: 137 to SEQ ID NO: 141, SEQ ID NO: 146 to SEQ ID NO: 150, SEQ ID NO: 162 to SEQ ID NO: 166, SEQ. ID. NOS.:178 to SEQ ID NO: 182, SEQ ID NO: 199 to SEQ ID NO: 203, SEQ ID NO: 206 to SEQ ID NO: 210, SEQ ID NO: 230 to SEQ ID NO: 234, and SEQ ID NO: 238 to SEQ ID NO: 242. These FGFR fusion proteins may lack a native leader sequence. In an embodiment, the Fc polypeptide comprises an amino acid sequence of any of SEQ ID NO: 171 to SEQ ID NO: 173.

The invention further provides an FGFR fusion protein produced in a CHO cell or a 293 cell comprising a first polypeptide comprising an extracellular domain of an FGFR polypeptide or a variant thereof and a fusion partner, wherein the FGFR fusion protein can bind to one or more FGF ligand. In an embodiment, this FGFR fusion protein comprises an amino acid sequence of any of SEQ ID NO.: 100, SEQ ID NO.: 95 to SEQ ID NO.: 99, SEQ ID NO: 102 to SEQ ID NO.: 126, SEQ ID NO: 156 to SEQ ID NO: 157, SEQ ID NO: 162 to SEQ ID NO: 166, SEQ ID NO: 176 to SEQ ID NO: 182, SEQ ID NO: 198 to SEQ ID NO: 202, SEQ ID NO: 205 to SEQ ID NO: 210, SEQ ID NO: 228 to SEQ ID NO: 234, and SEQ ID NO: 236 to SEQ ID NO: 242. In an embodiment, this FGFR fusion protein lacks a native leader sequence. In an embodiment, it is produced using a CHEF expression system.

The invention yet further provides the use of any of the above-described FGFR fusion proteins as a medicament. It provides a composition comprising an effective amount of any of the above-described FGFR fusion proteins and a pharmaceutically acceptable carrier. The invention provides a kit comprising this composition in a container and instructions for its administration into a subject in need of such a composition. In an embodiment the kit comprises either a single dose or multiple doses of the FGFR fusion protein.

The invention provides a nucleic acid molecule comprising a polynucleotide that encodes any of the above-described FGFR fusion proteins. In an embodiment, a vector comprises this nucleic acid molecule and a promoter which regulates the expression of the nucleic acid molecule. The invention also provides a recombinant host cell comprising any of the above-described FGFR fusion proteins, this nucleic acid molecule, and/or this vector. In an embodiment, this recombinant host cell is a prokaryotic cell. In an embodiment, this recombinant host cell is a eukaryotic cell, for example, one of CHO or 293 lineage. In an embodiment, the invention provides a polypeptide expressed from such a recombinant host cell.

In another aspect, the invention provides a method of producing an FGFR fusion protein comprising providing the recombinant host cell described above and culturing it to express the FGFR fusion protein. In an embodiment, the method further comprises isolating the FGFR fusion protein from the cell culture. In an embodiment, the isolation procedure comprises contacting the expressed FGFR fusion protein with an affinity matrix, for example, Protein A, Protein G, Protein A/G, anti-Fc antibody, and anti-FGFR antibody. In an embodiment, the isolation further comprises contacting the FGFR fusion protein with a hydrophobic matrix.

In a further aspect, the invention provides a method of detecting the level of FGFR expression in a subject comprising providing a ligand to FGFR, providing a tissue sample from the subject, allowing the ligand and the sample to interact under conditions that permit specific FGFR binding, measuring the specific binding; and comparing the amount of specific binding to that of a control sample, wherein the ligand binds to at least one of FGFR1, FGFR2, FGFR3, FGFR4, and a fragment of any of these. The tissue sample may comprise a blood, serum, or plasma sample. In an embodiment, the tissue sample comprises a sample of a diseased tissue. In an embodiment, the tissue sample comprises a sample of a tumor tissue. In an embodiment, the testing comprises a protein-antibody binding or competition assay, or a nucleic acid hybridization assay. In an embodiment, the ligand comprises an FGF ligand or an antibody ligand.

The invention also provides a method of detecting the level of FGF expression in a subject comprising providing an FGFR or fragment thereof; providing a tissue sample from the subject; allowing the ligand and the sample to interact under conditions that permit specific binding; measuring the specific binding; and comparing the amount of specific binding to that of a control sample, wherein the FGFR or fragment thereof binds to the FGF. In an embodiment, the FGF is at least one of FGF-1, FGF-2, FGF-3, FGF-4, FGF-5, FGF-6, FGF-7, FGF-8, FGF-9, FGF-10, FGF-16, FGF-17, FGF-18, FGF-19 and FGF-20.

The invention further provides a method of inhibiting the viability or proliferation of a proliferative cell in vitro, in vivo, or ex vivo comprising providing a composition comprising an effective amount of an FGFR fusion protein, as described above, and a pharmaceutically acceptable carrier, and contacting the proliferative cell with an amount of the composition effective to inhibit the viability or proliferation of the proliferative cell. In an embodiment, the proliferative cell is present in a subject and the subject expresses a higher level of one or more FGF ligand than normal. In an embodiment, a tissue of this subject expresses a higher level of the FGF ligand than normal. In an embodiment, the FGF ligand binds to at least one of FGFR1-Fc, FGFR2-Fc, FGFR3-Fc, or FGFR4-Fc, or a variant of any of these, as determined by measuring binding interactions in real time. For example, this FGF may be selected from FGF-1, FGF-2, FGF-3, FGF-4, FGF-5, FGF-6, FGF-8, FGF-9, FGF-16, FGF-17, FGF-18, FGF-19 and FGF-20. In an embodiment, this method is performed wherein the proliferative cell is present in a subject and the subject expresses a higher level of an FGFR polypeptide than normal. In an embodiment, a tissue in the subject also expresses a higher level of the FGFR polypeptide, for example, FGFR1, FGFR2, FGFR3, or FGFR4, than normal. In an embodiment, this method inhibits the viability and/or proliferation of a proliferative cancer cell, a proliferative dysplastic cell, or a proliferative endothelial cell. In an embodiment, the proliferative cell comprises a breast cell, a pancreatic cell, a prostate cell, a lung cell, an ovarian cell, a kidney cell, a brain cell, a colorectal cell, a retinal cell, or another cell selected from any of Table 7-Table 13. In an embodiment, the subject expresses a higher level of an FGFR polypeptide than normal and a higher level of an FGF ligand than normal.

In yet a further aspect, the invention provides a method of treating cancer in a subject, comprising providing any of the above-described FGFR fusion proteins and administering an effective amount of the FGFR fusion protein to the subject. In an embodiment, the cancer comprises at least one subpopulation of cells that is dependent on or responsive to growth stimulation by an FGF ligand. In an embodiment, the cancer comprises at least one subpopulation of cells that is dependent on or responsive to an angiogenic factor for production of blood vessels for growth. In an embodiment, the cancer is resistant to VEGF signaling pathway inhibition. In an embodiment, the cancer comprises metastasizing cancer, for example bone metastasis. In an embodiment, the cancer comprises a hematologic cancer, for example, chronic myelogenous leukemia, chronic lymphocytic leukemia, acute myelocytic leukemia, or hairy cell leukemia. In an embodiment, the cancer comprises a solid tumor. In an embodiment, the cancer comprises breast cancer, pancreatic cancer, pituitary cancer, prostate cancer, lung cancer, ovarian cancer, renal cell cancer, oral squamous cell cancer, colorectal cancer, bladder cancer, retinal cancer, brain cancer, or another cancer listed in Table 7-Table 13.

In an embodiment, this method further comprises administering a second anti-cancer therapeutic to the subject, form example, one comprising a cytostatic agent, a cytotoxic agent, an anti-angiogenic agent, a second FGFR fusion protein, an inhibitor of PDGF signaling, an inhibitor of VEGF signaling, or an inhibitor of EGF signaling. The second anti-cancer therapeutic may be administered before, after, or contemporaneously with the administration of the FGFR fusion protein.

The invention also provides a method of inhibiting angiogenesis in a subject comprising providing any of the above-described FGFR fusion proteins and administering an amount of the FGFR fusion protein to the subject effective to inhibit angiogenesis. In an embodiment, this method further comprises administering a second therapeutic agent to the subject, for example, a cytostatic agent, a cytotoxic agent, or a second anti-angiogenic agent.

In an embodiment of this method, the subject is treated for macular degeneration. In an embodiment, the subject is treated for cancer. In an embodiment, the second therapeutic agent comprises an anti-cancer therapeutic agent, for example, a second FGFR fusion protein, an inhibitor of PDGF signaling, an inhibitor of VEGF signaling, an inhibitor of EGF signaling, an antibody, or an siRNA. In an embodiment, the invention provides a method of treating angiogenesis in a subject that has been or is being treated with Avastin®.

The invention provides a method of inhibiting the viability or proliferation of a proliferative cell in vitro, in vivo, or ex vivo; a method of treating cancer, and an method of treating angiogenesis by administering a composition comprising an effective amount of any of the above-described FGFR fusion proteins intravenously, intramuscularly, subcutaneously, topically, orally, intraperitoneally, intraorbitally, by implantation, by inhalation, intrathecally, intraventricularly, and/or intranasally. In an embodiment, the method further comprises administering a second, anti-cancer therapeutic agent to the subject, wherein the second agent comprises surgery, chemotherapy, radiation therapy, and/or the administration of another biologic.

The invention also provides the use of any of the above-described FGFR fusion proteins for the manufacture of a medicament for treatment of a proliferative disease, for example, cancer or macular degeneration. In an embodiment, the cancer comprises a hematologic cancer or a solid cancer. In an embodiment, the cancer comprises breast cancer, pancreatic cancer, pituitary cancer, prostate cancer, lung cancer, ovarian cancer, renal cancer, oral cancer, colorectal cancer, bladder cancer, retinal cancer, brain cancer, or another cancer identified in Table 7-Table 13.

The invention provides a product comprising an FGFR fusion protein as described above and at least one anti-cancer therapeutic as a combined preparation for simultaneous, separate, or sequential use to treat cancer.

BRIEF DESCRIPTION OF THE DRAWINGS AND TABLES

Brief Description of the Drawings

The accompanying drawings, which are incorporated into and constitute a part of this specification, illustrate several embodiments consistent with the invention. Together with the description, they serve to explain the principles of the invention, but do not limit the invention.

FIG. 1A shows an amino acid sequence alignment of a portion of the extracellular and transmembrane domains of the seven FGFR isoforms, FGFR3-IIIb, FGFR3-IIIc, FGFR1-IIIb, FGFR1-IIIc, FGFR2-IIIb, FGFR2-IIIc, and FGFR4, denoting the immunoglobulin (Ig) III domain, the truncation locations of the FGFR1 mutants R1Mut1, R1Mut2, R1Mut3, R1Mut4, and R1Mut5 variants, and the position of the Fc portion of the fusion protein.

FIG. 18 lists cancer cell lines which were tested for their sensitivity to inhibition of their viability and proliferation by FGFR1-IIIc-Fc. Their malignancy origins and their sensitivity to FGFR1-IIIc-Fc is shown.

FIG. 21 summarizes the results shown in FIG. 20 by listing the percent inhibition of the viability and proliferation of A549, U118, U251, SF268, T47D, and Caki-1 tumor cells induced by FGFR1-IIIb-Fc, FGFR1-IIIc-Fc, FGFR2-IIIb-Fc, FGFR2-IIIc-Fc, FGFR3-IIIb-Fc, FGFR3-IIIc-Fc, and FGFR4-Fc, respectively.

DEFINITIONS

Figure 1B:
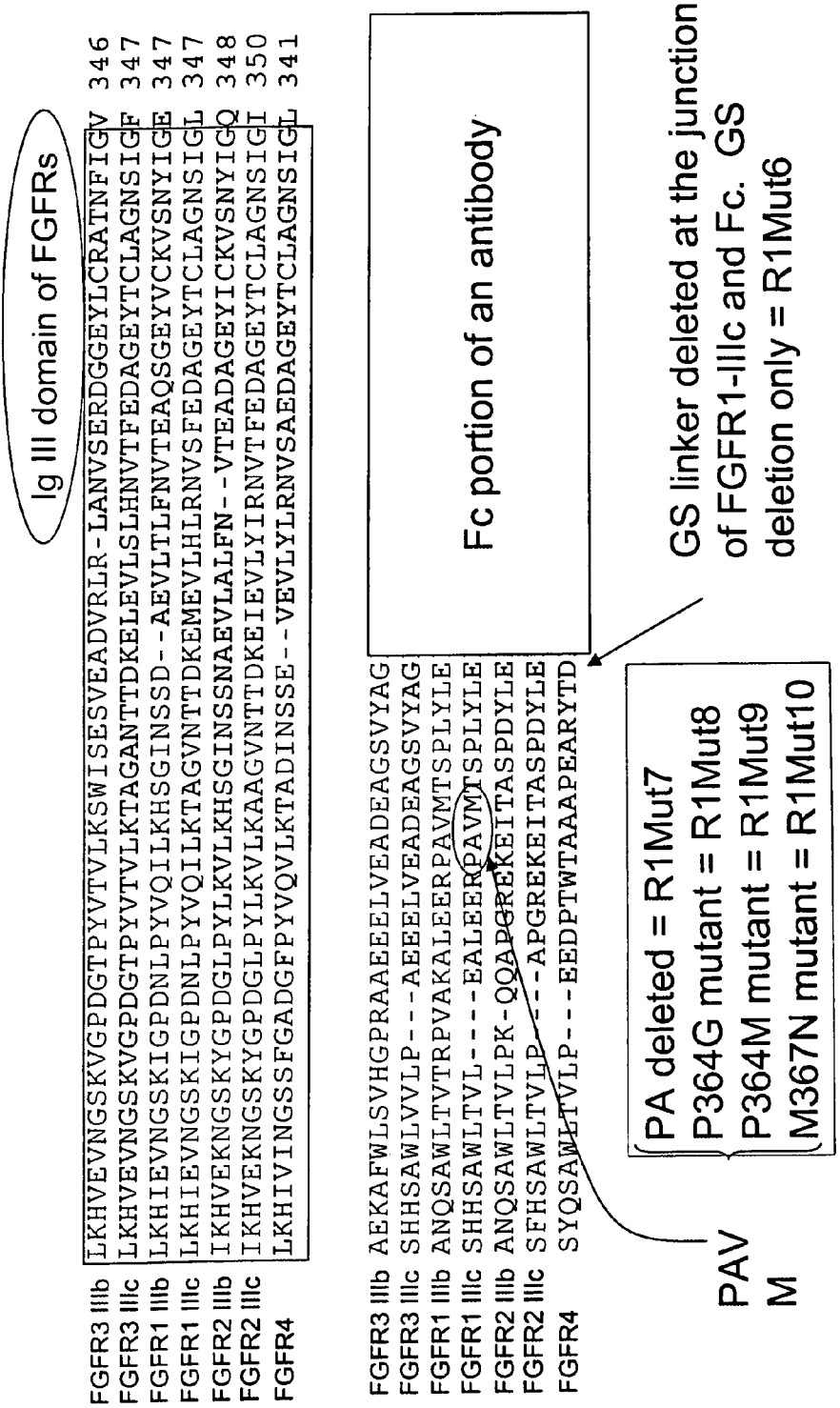
FIG. 1B shows the same amino acid sequence alignment as FIG. 1A, denoting the locations of the FGFR1 mutants R1Mut6, R1Mut7, R1Mut8, R1Mut9 and R1Mut10.

The terms used herein have their ordinary meanings, and, more specifically, as set forth below, and as can be further understood in the context of the specification.

The terms "nucleic acid molecule" and "polynucleotide" may be used interchangeably to refer to a polymer of nucleotides, such as DNA; RNA; RNAi; siRNA, whether genomic or cDNA or cRNA or anti-sense RNA; and may contain natural or non-natural nucleic acids or polynucleotides or active fragments thereof.

The terms "polypeptide" and "protein" are used interchangeably to refer to a polymer of amino acid residues, comprising natural or non-natural amino acid residues, and are not limited to a minimum length. Thus, peptides, oligopeptides, dimers, multimers, and the like are included within the definition. Both full-length proteins and fragments thereof are encompassed by the definition. The terms also include post-translational modifications of the polypeptide, including, for example, glycosylation, sialylation, acetylation, and phosphorylation. Furthermore, a "polypeptide" herein also refers to a modified protein such as single or multiple amino acid residue deletions, additions, and substitutions to the native sequence, as long as the protein maintains a desired activity. For example, a serine residue may be substituted to eliminate a single reactive cysteine or to remove disulfide bonding or a conservative amino acid substitution may be made to eliminate a cleavage site. These modifications may be deliberate, as through site-directed mutagenesis, or may be accidental, such as through mutations of hosts which produce the proteins or errors due to polymerase chain reaction (PCR) amplification.

An "extracellular domain" ("ECD") is the portion of a polypeptide that extends beyond the transmembrane domain into the extracellular space. The term "extracellular domain," as used herein, may comprise a complete extracellular domain or may comprise a truncated extracellular domain missing one or more amino acids. The extracellular domains of FGFRs (defined below) bind to one or more FGFs. The composition of the extracellular domain may depend on the algorithm used to determine which amino acids are in the membrane. Different algorithms may predict, and different systems may express, different extracellular domains for a given FGFR. For example, a tyrosine (Y) residue may be considered as the first amino acid residue in the transmembrane domain or the last amino acid residue of the extracellular domain, depending on the method used to determine the extracellular domain.

A "fibroblast growth factor receptor" (FGFR) polypeptide, as used herein, is a polypeptide comprising the entirety or a portion of FGFR1, FGFR2, FGFR3, or FGFR4 including all its naturally occurring isoforms or allelic variants. An "FGFR1 polypeptide," for example, refers to a polypeptide having the amino acid sequence of any one of the known FGFR1 polypeptides, such as FGFR1-IIIb and FGFR1-IIIc, and any fragment thereof, including those described in U.S. Pat. Nos. 6,656,728; 6,384,191; 5,229,501; 6,255,454; 6,344,546; 5,474,914; and 5,288,855. FGFR1-IIIb and FGFR1-IIIc differ from each other in their IgIII domains (defined below). An FGFR2 polypeptide, for example, refers to a polypeptide having the amino acid sequence of any one of the known FGFR2 polypeptides, for example, FGFR2-IIIb and FGFR2-IIIc, and any fragments thereof. FGFR2-IIIb and FGFR2-IIIc differ from each other also in the IgIII domains. An "FGFR3 polypeptide," for example, refers to a polypeptide having the amino acid sequence of any one of the known FGFR3 polypeptides, for example, FGFR3-IIIb and FGFR3-IIIc and any fragments thereof. FGFR3-IIIb and FGFR3-IIIc also differ from each other in their IgIII domains. An "FGFR4 polypeptide," for example, refers to a polypeptide having the amino acid sequence of any one of the known FGFR4 polypeptides, and any fragments thereof.

An "FGFR fusion protein" is a protein as defined in the Tables and Sequence Listing and typically comprises a sequence of amino acids corresponding to the extracellular domain of an FGFR polypeptide or a biologically active fragment thereof, and a fusion partner. The fusion partner may be joined to either the N-terminus or the C-terminus of the FGFR polypeptide and the FGFR may be joined to either the N-terminus or the C-terminus of the fusion partner. An FGFR fusion protein can be a product resulting from splicing strands of recombinant DNA and expressing the hybrid gene. It can be made by genetic engineering, for example, by removing the stop codon from the DNA sequence of the first protein, then appending the DNA sequence of the second protein in frame, so that the DNA sequence is expressed as a single protein. Typically, this is accomplished by cloning a cDNA into an expression vector in frame with an existing gene. An FGFR fusion protein may comprise a fusion partner comprising amino acid residues that represent all of, or more than one fragment of, more than one gene. An FGFR fusion protein may also comprise a fusion partner which is not a polypeptide, but which is chemically attached.

The "valine residue that is situated at the C-terminus of the IgIII domain and commonly aligned among the wildtype FGFR1, FGFR2, FGFR3, and FGFR4 ECD C-termini" is the valine (V) residue shown in bold below.

```
R1-IIIb   348   ANQSAWLTVTRPVAKALEERPAVMTSPLYLE

R1-IIIc   348   SHHSAWLTVL----EALEERPAVMTSPLYLE

R2-IIIb   349   ANQSAWLTVLPK-QQAPGREKEITASPDYLE

R2-IIIC   351   SFHSAWLTVLP----APGREKEITASPDYLE

R3-IIIb   347   AEKAFWLSVHGPRAAEEELVEADEAGSVYAG

R3-IIIc   348   SHHSAWLVVLP---AEEELVEADEAGSVYAG

R4        342   SYQSAWLTVLP---EEDPTWTAAAPEARYTD
```

A "fusion partner" is any component of a fusion molecule in addition to the extracellular domain of an FGFR or fragment thereof. A fusion partner may comprise a polypeptide, such as a fragment of an immunoglobulin molecule, or a non-polypeptide moiety, for example, polyethylene glycol. The fusion partner may comprise an oligomerization domain such as an Fc domain of a heavy chain immunoglobulin.

An "FGF ligand" is a fibroblast growth factor, or variant or fragment thereof, which binds to an FGFR. Currently, the known FGF ligands include FGF-1, FGF-2, FGF-3, FGF-4, FGF-5, FGF-6, FGF-7, FGF-8, FGF-9, FGF-10, FGF-11, FGF-12, FGF-13, FGF-14, FGF-15, FGF-16, FGF-17, FGF-18, FGF-19, FGF-20, FGF-21, FGF-22, and FGF-23. Each FGF may bind to one or more FGFR. An FGF ligand is "over-expressed" when it is expressed at a higher level than normal for the cell, tissue, or organism expressing the ligand.

A "fragment crystallizable (Fc) polypeptide" is the portion of an antibody molecule that interacts with effector molecules and cells. It comprises the C-terminal portions of the immunoglobulin heavy chains. As used herein, an Fc polypeptide comprises a fragment of the Fc domain with one or more biological activity of an entire Fc polypeptide. An "effector function" of the Fc polypeptide is an action or activity performed in whole or in part by an antibody in response to a stimulus and may include complement fixation or ADCC (antibody-dependent cellular cytotoxicity) induction.

"Wildtype" refers to a non-mutated version of a gene, allele, genotype, polypeptide, or phenotype, or a fragment of any of these. It may occur in nature or be produced recombinantly. A "wildtype FGFR ECD" refers to a protein or a nucleic acid molecule that contains an amino acid sequence or nucleic acid sequence that is identical to that of a wildtype extracellular domain of an FGFR, in whole or in part, including all isoforms of FGFR1, FGFR2, FGFR3, and FGFR4.

A "variant" is a nucleic acid molecule or polypeptide that differs from a referent nucleic acid molecule or polypeptide by single or multiple amino acid substitutions, deletions, and/or additions and substantially retains at least one biological activity of the referent nucleic acid molecule or polypeptide.

A "point mutation" is a mutation that involves a single nucleotide or amino acid residue. The mutation may be the loss of a nucleotide or amino acid, substitution of one nucleotide or amino acid residue for another, or the insertion of an additional nucleotide or amino acid residue.

"Leader sequence" refers to a sequence of amino acid residues or polynucleotides encoding such, which facilitates secretion of a polypeptide of interest and is typically cleaved upon export of the polypeptide to the outside of the cell surface membrane.

A "vector" is a plasmid that can be used to transfer DNA sequences from one organism to another or to express a gene of interest. A vector typically includes an origin of replication and regulatory sequences which regulate the expression of the gene of interest, and may or may not carry a selective marker gene, such as an antibiotic resistance gene. A vector is suitable for the host cell in which it is to be expressed. A vector may be termed a "recombinant vector" when the gene of interest is present in the vector.

A "host cell" is an individual cell or cell culture which can be or has been a recipient of any recombinant vector or isolated polynucleotide. Host cells include the progeny of a single host cell, which may not necessarily be completely identical, for example, in morphology or in total DNA complement, to the original parent cell due to natural, accidental, or deliberate mutation and/or change. A host cell includes a cell transfected or infected in vivo or in vitro with a recombinant vector or a polynucleotide of the invention. A host cell which comprises a recombinant molecule may be called a "recombinant host cell." Host cells may be prokaryotic cells or eukaryotic cells. Eukaryotic cells suitable for use as host cells include mammalian cells, such as primate or non-primate animal cells; fungal cells; plant cells; and insect cells. For example, host cells may be derived from 293 or CHO cells.

A "promoter" is a DNA regulatory region capable of binding RNA polymerase in a cell and initiating transcription of a downstream (5' to 3' direction) coding sequence operably linked thereto. Promoters include those that are naturally contiguous to a nucleic acid molecule and those that are not naturally contiguous to a nucleic acid molecule. Additionally, the term "promoter" includes inducible promoters, conditionally active promoters such as a cre-lox promoter, tet inducible promoters, constitutive promoters, and tissue specific promoters. An "exogenous promoter" is one that is not operatively linked to a gene of interest in the naturally-occurring state.

"CHEF expression system" refers to an expression system utilizing regulatory DNA sequences derived from the hamster elongation factor-1 (EF-1) alpha gene, as described in U.S. Pat. No. 5,888,809 as the regulatory sequences. CHEF expression systems may use Chinese hamster ovary (CHO) cells as host cells.

The CHEF expression system comprises regulatory DNA sequences 5' to translated regions of the Chinese hamster ovary EF-1 alpha gene and includes approximately 3.7 kb DNA extending from a Spe1 restriction site to the initiating methionine (ATG) codon of the EF-1alpha protein. Polynucleotides of less than 3.7 kb are also included in as much as the smaller fragment polynucleotides are capable of increasing transcription of an operatively linked gene. Examples of plasmids containing this regulatory system include pDEF2 and pDEF10. Plasmid pDEF2 in *E. coli* strain XL-1 Blue was deposited with from American Type Tissue Collection, 10801 University Boulevard, Manassas, Va. 20110 and assigned Accession Number 98343.

"Isolating" a protein from cell culture means separating the protein from the remainder of the materials in the cell culture. "Isolating" can mean achieving a partial or a complete separation of the protein from the culture. "Isolating" and "purifying" are used interchangeably, as are "isolated" and "purified."

An "affinity matrix" refers to a composition that shows preferential affinity to a polypeptide or polynucleotide of interest and is used for purification or isolation of such from other materials naturally present in its environment, for example, in a cell culture. Materials suitable for use as an affinity matrix include, but are not limited to, Protein A, Protein G, a combination of Protein A and G, and an antibody, such as that attached to a solid substrate.

A "biologically active" entity, or an entity having "biological activity," is an entity having any function related to or associated with a metabolic or physiological process, and/or having structural, regulatory, or biochemical functions of a naturally-occurring molecule. Biologically active polynucleotide fragments are those exhibiting activity similar, but not necessarily identical, to an activity of a polynucleotide of the present invention. A biologically active polypeptide or fragment thereof includes one that can participate in a biological reaction, including, but not limited to, a ligand-receptor interaction or antigen-antibody binding. The biological activity can include an improved desired activity, or a decreased undesirable activity. An entity may demonstrate biological activity when it participates in a molecular interaction with another molecule, such as hybridization, when it has therapeutic value in alleviating a disease condition, when it has prophylactic value in inducing an immune response, when it has diagnostic and/or prognostic value in determining the presence of a molecule, such as a biologically active fragment of a polynucleotide that may be detected as unique for the polynucleotide molecule, and when it can be used as a primer in a polymerase chain reaction (PCR).

"Subject," "individual," "host," "animal," and "patient" are used interchangeably herein to refer to mammals, including, but not limited to, rodents, simians, humans, felines, canines, equines, bovines, porcines, ovines, caprines, mammalian laboratory animals, mammalian farm animals, mammalian sport animals, and mammalian pets.

A "tissue sample" is any biological specimen derived from a patient. The term includes, but is not limited to, biological fluids such as blood, serum, plasma, urine, cerebrospinal fluid, tears, saliva, lymph, dialysis fluid, lavage fluid, semen, and other liquid samples, as well as cell and tissues of biological origin. The term also includes cells or cells derived therefrom and the progeny thereof, including cells in culture, cell supernatants, and cell lysates. It further includes organ or tissue culture-derived fluids, tissue biopsy samples, tumor biopsy samples, stool samples, and fluids extracted from physiological tissues, as well as cells dissociated from solid tissues, tissue sections, and cell lysates. This definition encompasses samples that have been manipulated in any way after their procurement, such as by treatment with reagents, solubilization, or enrichment for certain components, such as polynucleotides or polypeptides. Also included in the term are derivatives and fractions of patient samples. A patient sample may be used in a diagnostic, prognostic, or other monitoring assay.

A "growth factor receptor signaling inhibitor," such as a "PDGF signaling inhibitor," a "VEGF signaling inhibitor," or an "EGF signaling inhibitor" is an agent that diminishes the effects of one or more of a series of events, such as in a signaling transduction pathway, beginning with the binding of the growth factor to its receptor and ending with a biological response, such as a proliferative response. A growth factor receptor signaling inhibitor may diminish one or more of many events, occurring both in series and in parallel, including signal transduction, kinase activation, gene activation, and cell cycle modulation.

The terms "antibody" and "immunoglobulin" refer to a protein, generated by the immune system, made synthetically, or made recombinantly, that is capable of recognizing and binding to a specific antigen; antibodies are commonly known in the art. They can be polyclonal antibodies, monoclonal antibodies, single chain antibodies or antigen binding fragments thereof.

"Angiogenesis" is the development of new blood vessels, including capillary vessels. It can take place in health or disease, including cancer. The term includes neovascularization, revascularization, angiopoiesis, and vasculogenesis. New blood vessel growth typically results from stimulation of endothelial cells by angiogenic factors which may be active in proliferative conditions, such as in cancer or macular degeneration. An "angiogenic factor" is one that promotes angiogenesis.

"Cancer" and "tumor" are interchangeable terms that refer to any abnormal cell or tissue growth or proliferation in an animal. As used herein, the terms "cancer" and "tumor" encompass solid and hematological/lymphatic cancers and also encompass malignant, pre-malignant, and benign growth, such as dysplasia.

"Metastasis" is the spread or dissemination of a disease-process, for example cancer, from one part of the body to another. It includes the spread or dissemination from an initial or primary site of disease to another site. "Metastasis" also refers to the process by which such spreading or dissemination occurs. The term is not limited to the mechanism of spread or dissemination. "Metastasis" includes the spread or dissemination of cancer cells by the lymphatics or blood vessels or by direct extension through serous cavities or sub-arachnoid or other spaces.

"Macular degeneration" is any condition in which the cells of the macula lutea degenerate, eventually resulting in blurred vision and possibly in blindness.

"Treatment," as used herein, covers any administration or application of a therapeutic for disease in a mammal, including a human, and includes inhibiting the disease, arresting its development, or relieving the disease, for example, by causing regression, or restoring or repairing a lost, missing, or defective function; or stimulating an inefficient process. Treatment may achieved with surgery, radiation, chemotherapy, and/or with a biologic.

A "pharmaceutically acceptable carrier" refers to a non-toxic solid, semisolid, or liquid filler, diluent, encapsulating material, formulation auxiliary, or carrier conventional in the art for use with a therapeutic agent for administration to a subject. A pharmaceutically acceptable carrier is non-toxic to recipients at the dosages and concentrations employed and is compatible with other ingredients of the formulation. The pharmaceutically acceptable carrier is appropriate for the formulation employed. For example, if the therapeutic agent is to be administered orally, the carrier may be a gel capsule. If the therapeutic agent is to be administered subcutaneously, the carrier ideally is not irritable to the skin and does not cause injection site reaction.

A "biologic" is a product which is naturally produced in some form by living organisms, whether modified or unmodified, whether in whole or a fragment thereof. A biologic may be prepared from a living source, such as animal tissue. The term includes, but is not limited to, a polynucleotide, polypeptide, antibody, cell, virus, toxin, vaccine, blood component or derivative, and fusion protein. A "biologic" may be used to treat an animal, including a human.

"Surface plasmon resonance" is a reduction in reflected light intensity which occurs when light is reflected off a thin metal film and a fraction of the incident light energy can interact with delocalised electrons in the metal film (plasmon).

FGFR Extracellular Domain Fusion Molecules

The FGFR fusion molecules of the invention comprise a first polypeptide that comprises an extracellular domain (ECD) of an FGFR polypeptide and a fusion partner. The FGFR polypeptide can be any of FGFR1, FGFR2, FGFR3, and FGFR4, including all their variants and isoforms. Hence, the family of FGFR polypeptides suitable for use in the invention includes FGFR1-IIIb, FGFR1-IIIc, FGFR2-IIIb, FGFR2-IIIc, FGFR3-IIIb, FGFR3-IIIc, and FGFR4, for example. The extracellular domain of the FGFR can be the entire ECD or a portion thereof. The FGFR ECD is modified, as compared to the wildtype FGFR ECD, and possesses ligand binding activity. The modifications may be single or multiple amino acid deletions, additions, or substitutions. FGFR extracellular domains can be attached to fusion partners that provide desired pharmacokinetic properties, for example, increasing their half-life in vivo. The fusion partner of the FGFR fusion molecules of the invention can be any fusion partner conventional in the art, including those having oligomerization domains, such as dimerization domains, for example, an Fc fragment. Fusion partners of the invention also include those made by chemical modifications, such as pegylation.

FGFRs bind their cognate FGFs via their extracellular domains, thus the extracellular domain determines the ligand binding specificity. The FGFR extracellular domain can comprise up to three immunoglobulin-like (Ig-like) domains, IgI, IgII, and IgIII domains. Alternative mRNA splicing produces several forms of the extracellular domains. One splicing event eliminates the amino-terminal Ig-like domain (domain I) resulting in a short form of the receptor with only two Ig-like domains. Another mRNA splicing event takes place in FGFR1, FGFR2, and FGFR3, which results in three alternative versions of Ig-like domain III; namely, IIIa, IIIb, and IIIc. So far, FGFR4 has not been reported to be alternatively spliced in this region. The third immunoglobulin-like domain can produce receptor splice variants with different ligand binding properties.

The invention provides compositions comprising and methods of using such FGFR fusion molecules. FGFR fusion molecules of the invention can include the ECDs of FGFR1, for example those described in U.S. Pat. Nos. 6,384,191; 6,656,728; 5,229,501; 6,344,546; and 5,474,914; including those annotated as NP_075594, NP_056934, or NP_000595, as described by the National Center for Bioinformatics Information (NCBI). FGFR fusion molecules of the invention can also include the ECDs of FGFR2, for example those annotated as 15281415 and NP_000132. FGFR fusion molecules of the invention can further include the ECDs of FGFR3, for example, those annotated as NP_056934, 17939658, P22607, NP_000133, or NP_075254. FGFR fusion molecules of the invention can yet further include the ECDs of FGFR4, for example those annotated NP_002002, 13991618, 2832350, 31372, and 182571.

The fusion proteins of the invention can comprise an entire ECD or a portion of the ECD of wildtype or variant FGFRs. For example, the fusion proteins of the invention can comprise the entire FGFR1 ECD, including that of wildtype FGFR1-IIIb or wildtype FGFR1-IIIc ECD. The invention can also comprise a variant of the wildtype FGFR1 ECD, such as one having deletion of one or more and up to 22 amino acid residues, counting from the C-terminus of the wildtype FGFR1 ECD, provided that the variant ECD retains at least one of its FGF ligand binding activities. In an embodiment, the FGFR1 ECD has the 22 amino acids at the C-terminus deleted. In an embodiment, the deletion does not extend to or include the valine residue at amino acid residue 356 of the wildtype full length FGFR1-IIIb or FGFR1-IIIc. Examples of such variants include those having amino acid residues LYLE deleted (SEQ ID NO: 243), those having amino acid residues PLYLE (SEQ ID NO: 244) deleted, those having amino acid residues MTSPLYLE deleted (SEQ ID NO: 245), those having amino acid residues AVMTSPLYLE deleted (SEQ ID NO: 246), those having amino acid residues VMTSPLYLE (SEQ ID NO: 247) deleted, those having amino acid residues EERPAVMTSPLYLE deleted (SEQ ID NO: 248), those having amino acid residues LEERPAVMTSPLYLE deleted (SEQ ID NO: 249), those having amino acid residues KALEERPAVMTSPLYLE deleted (SEQ ID NO: 250), those having amino acid residues EALEERPAVMTSPLYLE deleted (SEQ ID NO: 251), and those having amino acid residues RPVAKALEERPAVMTSPLYLE deleted (SEQ ID NO: 252), all as compared to wildtype FGFR1-IIIb or FGFR1-IIIc.

In an embodiment, the fusion proteins of the invention can comprise an entire FGFR2 ECD, including that of wildtype FGFR2-IIIb or wildtype FGFR2-IIIc ECD. The invention can also comprise a variant of the wildtype FGFR2 ECD, such as one having deletion of one or more and up to 22 amino acid residues, counting from the C-terminus of the wildtype FGFR2 ECD, provided that the variant ECD retains at least one of its FGF ligand binding activities. In an embodiment, the FGFR2 ECD has the 22 amino acids at the C-terminus deleted. In an embodiment, the deletion does not extend to or include the valine residue at amino acid residue 357 of the wildtype full length FGFR2-IIIb or amino acid residue 359 of the wildtype full length FGFR2-IIIc. Examples of such variants include those having amino acid residues DYLE deleted (SEQ ID NO: 253), those having amino acid residues PDYLE deleted (SEQ ID NO: 254), those having amino acid residues TASPDYLE deleted (SEQ ID NO: 255), those having amino acid residues ITASPDYLE deleted (SEQ ID NO: 256), those having amino acid residues EITASPDYLE deleted (SEQ ID NO: 257), those having amino acid residues GREKEITASPDYLE deleted (SEQ ID NO: 258), those having amino acid residues PGREKEITASPDYLE deleted (SEQ ID NO: 259), those having amino acid residues APGREKEITASPDYLE deleted (SEQ ID NO: 260), those having amino acid residues PAPGREKEITASPDYLE deleted (SEQ ID NO: 261), those having amino acid residues QAPGREKEITASPDYLE deleted (SEQ ID NO: 262), and those having amino acid residues PKQQAPGREKEITASPDYLE deleted (SEQ ID NO: 263), all as compared to wildtype FGFR2-IIIb or FGFR2-IIIc.

In an embodiment, the fusion proteins of the invention can comprise an entire FGFR3 ECD, including that of wildtype FGFR3-IIIb or wildtype FGFR3-IIIc ECD. The invention can also comprise a variant of the wildtype FGFR3 ECD, such as one having deletion of one or more and up to 22 amino acid residues, counting from the C-terminus of the wildtype FGFR3 ECD, provided that the variant ECD retains at least one of its FGF ligand binding activities. In an embodiment, the FGFR3 ECD has the 22 amino acids at the C-terminus deleted. In an embodiment, the deletion does not extend to or include the valine residue at amino acid residue 355 of the wildtype full length FGFR3-IIIb or amino acid residue 356 of the wildtype full length FGFR3-IIIc. Examples of such variants include those having amino acid residues VYAG deleted (SEQ ID NO: 264), those having amino acid residues SVYAG deleted (SEQ ID NO: 265), those having amino acid residues EAGSVYAG deleted (SEQ ID NO: 266), those having amino acid residues DEAGSVYAG deleted (SEQ ID NO: 267), those having amino acid residues ADEAGSVYAG deleted (SEQ ID NO: 268), those having amino acid residues ELVEADEAGSVYAG deleted (SEQ ID NO: 269), those having amino acid residues EELVEADEAGSVYAG deleted (SEQ ID NO: 270), those having amino acid residues AEEELVEADEAGSVYAG deleted (SEQ ID NO: 271), those having amino acid residues PAEEELVEADEAGSVYAG deleted (SEQ ID NO: 272), and those having amino acid residues GPRAAEEELVEADEAGSVYAG deleted (SEQ ID NO: 273), all as compared to wildtype FGFR3-IIIb or FGFR3-IIIc.

In an embodiment, the fusion proteins of the invention can comprise an entire FGFR3 ECD, including that of wildtype FGFR4 ECD. The invention can also comprise a variant of the wildtype FGFR4 ECD, such as one having deletion of one or more and up to 22 amino acid residues, counting from the C-terminus of the wildtype FGFR4 ECD, provided that the variant ECD retains at least one of its FGF ligand binding activities. In an embodiment, the FGFR4 ECD has the 22 amino acids at the C-terminus deleted. In an embodiment, the deletion does not extend to or include the valine residue at amino acid residue 351 of the wildtype full length FGFR4. Examples of such variants include those having amino acid residues RYTD deleted (SEQ ID NO: 274), those having amino acid residues ARYTD deleted (SEQ ID NO: 275), those having amino acid residues APEARYTD deleted (SEQ ID NO: 276), those having amino acid residues AAPEARYTD deleted (SEQ ID NO: 277), those having amino acid residues AAAPEARYTD deleted (SEQ ID NO: 278), those having amino acid residues PTWTAAAPEARYTD deleted (SEQ ID NO: 279), those having amino acid residues DPTWTAAAPEARYTD deleted (SEQ ID NO: 280), those having amino acid residues EEDPTWTAAAPEARYTD deleted (SEQ ID NO: 281), and those having amino acid residues PEEDPTWTAAAPEARYTD deleted (SEQ ID NO: 282), all as compared to wildtype FGFR4.

In an embodiment, the fusion proteins of the invention can comprise variants that are point mutants, provided that they retain at least one FGF ligand binding activity. The point mutants can include any one or more of the amino acid residue additions, deletions, or substitutions in the same regions of the C-terminus mentioned previously, that is, up to the valine residue at position 356 of FGFR1-IIIb or FGFR1-IIIc; position 357 of FGFR2-IIIb; position 359 of FGFR2-IIIc; position 355 of FGFR3-IIIb; position 356 of FGFR3-IIIc; and position 350 of FGFR4. For example, any one or more of the amino acid residues PAVM at positions 364-367 of the full length FGFR1-IIIb or FGFR1-IIIc may be added, deleted, or substituted.

The C-terminus of the extracellular and transmembrane domains of the FGFR polypeptides may differ, depending on the method used to identify the extracellular domain. Different algorithms predict different start residues for the transmembrane domain, thus different end residues for the extracellular domain. For example, the extracellular domain of FGFR1-IIIc, is shown in the sequence listing (SEQ ID NO: 92) as ending with the amino acid sequence "YLE." Table 2 indicates that the transmembrane regions of FGFR1-IIIc NP_056934, NP_075594, and NP_000595 begin with amino acid residues 373, which corresponds to the "L" in the "YLE" sequence. Thus, the "LE" residues may be considered as belonging either to the extracellular domain or the transmembrane domain of FGFR1-IIIc depending on the algorithm used for the prediction. This concept applies to all of the FGFRs described herein. Thus, with respect to FIG. 1, the extracellular domain of FGFR3-III may end in "VYAG" or "VY," the ECD of FGFR3-IIIc may end in "VYAG" or "VY," the ECD of FGFR1-IIIb may end in "LYLE" or "LE," the ECD of FGFR1-IIIc may end in "LYLE" or "LY," the ECD of FGFR2-IIIb may end in "DYLE" or "DY," the ECD of FGFR2-IIIc may end in "DYLE" or "DY," and the ECD of FGFR4 may end in "RYTD" or "RY."

The invention provides FGFR fusion proteins comprising a fusion partner. The fusion partner can be a molecule having a dimerization domain, such as an Fc fragment of an immunoglobulin heavy chain. The Fc fragment may be a wildtype Fc found in a naturally occurring antibody, a variant thereof, or a fragment thereof. In an embodiment, the Fc fragment belongs to the IgG1, IgG2, or IgG4 class. In an embodiment, the invention provides fusion molecules including, but not limited to, an Fc fragment of an immunoglobulin molecule belonging to the IgG1 class and/or having a C237S mutation.

The invention provides FGFR fusion proteins comprising a linker which connects the first polypeptide and fusion partner. The fusion proteins of the invention may be used interchangeably with or without such a linker. In an embodiment, the linker comprises the amino acids GS or any nucleotide sequence encoding GS. The linker may be convenient for constructing at least the first DNA construct in attaching the nucleic acid encoding the fusion protein to the nucleic acid encoding the FGFR ECD. Any linker conventional in the art may be used for this purpose to the extent that it does not diminish the desired properties of the fusion protein.

The invention also provides multimeric FGFR fusion proteins that comprise more than one FGFR extracellular domain. For example, the invention provides FGFR fusion proteins, where the fusion partner comprises a second FGFR extracellular domain which is the same as the first polypeptide, forming a homodimer; or an a second FGFR extracellular domain which is different from the first polypeptide, forming a heterodimer, or a biologically active fragment of either of these. Such a fusion protein may increase the affinity of the fusion protein to FGF ligand binding or expand the range of FGF ligands that can bind to the fusion protein. Its components may include two FGFR1 extracellular domains, two FGFR2 extracellular domains, two FGFR3 extracellular domains, two FGFR4 extracellular domains, or biologically active fragments of any of these. It may also include heterologous combinations of FGFR1, FGFR2, FGFR3, and FGFR4 extracellular domains, or biologically active fragments of any of these.

The sequences of the FGFR fusion molecules of the invention are provided in the Sequence Listing and are further described in the Tables. Their sequence designations include both published sequences and the novel fusion proteins of the invention. The types of sequences include extracellular domains, linkers, fusion partners, deletion mutants, and other mutants.

Table 1 shows the FGFR sequences of the Sequence Listing. Column 1 shows the internally designated identification number (Patent ID). Column 2 shows the nucleotide sequence ID number for the nucleic acids encoding the open reading frames of some of the polypeptides listed in column 3 (SEQ. ID. NO. (N1)). Column 3 shows the amino acid sequence ID number for the polypeptide sequences (SEQ. ID. NO. (P1)). Column 4 provides a description of the polypeptides, including the NCBI accession numbers when applicable (Protein ID). Column 5 provides a brief description of the encoded protein, designating the FGFR family (Protein). Column 6 provides an annotation of the protein, including a description of the variant FGFR, when applicable (Annotation). Column 7 provides a description of the variant or parental construct, including amino acid residues deleted or changed, when applicable (Description).

TABLE 1

SEQ ID NOS and Protein Identification

| Patent ID | SEQ. ID. NO. (N1) | SEQ. ID. NO. (P1) | Protein ID | Protein | Annotation | Description |
|---|---|---|---|---|---|---|
| HG1020122 | SEQ ID NO: 1 | SEQ ID NO: 92 | NP_056934_1-374 | FGFR1IIIc | ECD only | |
| HG1020123 | SEQ ID NO: 2 | SEQ ID NO: 93 | NP_075594_1-285 | FGFR1IIIc | ECD only | |
| HG1020124 | SEQ ID NO: 3 | SEQ ID NO: 94 | NP_000595_1-376 | FGFR1IIIc | ECD only | |
| HG1021602 | SEQ ID NO: 4 | SEQ ID NO: 95 | NP_056934_1-374_GS_17939658_233-464_C237S | FGFR1IIIc | FGFR1 + linker + Fc | parental construct |
| HG1020125 | SEQ ID NO: 5 | SEQ ID NO: 96 | NP_056934_1-374_17939658_233-464_C237S | FGFR1IIIc | R1Mut6 | del GS |
| HG1020127 | SEQ ID NO: 6 | SEQ ID NO: 97 | NP_056934_1-370_17939658_233-464_C237S | FGFR1IIIc | R1Mut1 | del LYLEGS |

TABLE 1-continued

SEQ ID NOS and Protein Identification

| Patent ID | SEQ. ID. NO. (N1) | SEQ. ID. NO. (P1) | Protein ID | Protein | Annotation | Description |
|---|---|---|---|---|---|---|
| HG1020126 | SEQ ID NO: 7 | SEQ ID NO: 98 | NP_056934_1-366_17939658_233-464_C237S | FGFR1IIIc | R1Mut2 | del MTSPLYLEGS |
| HG1020128 | SEQ ID NO: 8 | SEQ ID NO: 99 | NP_056934_1-365_17939658_233-464_C237S | FGFR1IIIc | R1Mut3 | del VMTSPLYLEGS |
| HG1020129 | SEQ ID NO: 9 | SEQ ID NO: 100 | NP_056934_1-360_17939658_233-464_C237S | FGFR1IIIc | R1Mut4 | del EERPAVMTSPLYLEGS |
| HG1020130 | SEQ ID NO: 10 | SEQ ID NO: 101 | NP_056934_1-355_17939658_233-464_C237S | FGFR1IIIc | R1Mut5 | del VLEALEERPAVMTSPLYLEGS |
| HG1020131 | SEQ ID NO: 11 | SEQ ID NO: 102 | NP_056934_1-374_D364-D365_17939658_233-464_C237S | FGFR1IIIc | R1Mut7 | del PA |
| HG1020132 | SEQ ID NO: 12 | SEQ ID NO: 103 | NP_056934_1-374_P364G_17939658_233-464_C237S | FGFR1IIIc | R1Mut8 | P364G |
| HG1020133 | SEQ ID NO: 13 | SEQ ID NO: 104 | NP_056934_1-374_P364M_17939658_233-464_C237S | FGFR1IIIc | R1Mut9 | P364M |
| HG1020134 | SEQ ID NO: 14 | SEQ ID NO: 105 | NP_056934_1-374_M367N_17939658_233-464_C237S | FGFR1IIIc | R1Mut10 | M367N |
| HG1020135 | SEQ ID NO: 15 | SEQ ID NO: 106 | NP_056934_1-374_P364M_M367N_17939658_233-464_C237S | FGFR1IIIc | R1Mut11 | P364M M367N |
| HG1020136 | SEQ ID NO: 16 | SEQ ID NO: 107 | NP_075594_1-285_17939658_233-464_C237S | FGFR1IIIc | R1Mut6 | del GS |
| HG1020138 | SEQ ID NO: 17 | SEQ ID NO: 108 | NP_075594_1-281_17939658_233-464_C237S | FGFR1IIIc | R1Mut1 | del LYLEGS |
| HG1020137 | SEQ ID NO: 18 | SEQ ID NO: 109 | NP_075594_1-277_17939658_233-464_C237S | FGFR1IIIc | R1Mut2 | del MTSPLYLEGS |
| HG1020139 | SEQ ID NO: 19 | SEQ ID NO: 110 | NP_075594_1-276_17939658_233-464_C237S | FGFR1IIIc | R1Mut3 | del VMTSPLYLEGS |
| HG1020140 | SEQ ID NO: 20 | SEQ ID NO: 111 | NP_075594_1-271_17939658_233-464_C237S | FGFR1IIIc | R1Mut4 | del EERPAVMTSPLYLEGS |
| HG1020141 | SEQ ID NO: 21 | SEQ ID NO: 112 | NP_075594_1-285_D275-D276_17939658_233-464_C237S | FGFR1IIIc | R1Mut7 | del PA |
| HG1020142 | SEQ ID NO: 22 | SEQ ID NO: 113 | NP_075594_1-285_P275G_17939658_233-464_C237S | FGFR1IIIc | R1Mut8 | P275G |
| HG1020143 | SEQ ID NO: 23 | SEQ ID NO: 114 | NP_075594_1-285_P275M_17939658_233-464_C237S | FGFR1IIIc | R1Mut9 | P275M |
| HG1020144 | SEQ ID NO: 24 | SEQ ID NO: 115 | NP_075594_1-285_M278N_17939658_233-464_C237S | FGFR1IIIc | R1Mut10 | M278N |
| HG1020145 | SEQ ID NO: 25 | SEQ ID NO: 116 | NP_075594_1-285_P275M_M278N_17939658_233-464_C237S | FGFR1IIIc | R1Mut11 | P275M M278N |
| HG1020146 | SEQ ID NO: 26 | SEQ ID NO: 117 | NP_000595_1-376_17939658_233-464_C237S | FGFR1IIIc | R1Mut6 | del GS |
| HG1020148 | SEQ ID NO: 27 | SEQ ID NO: 118 | NP_000595_1-372_17939658_233-464_C237S | FGFR1IIIc | R1Mut1 | del LYLEGS |
| HG1020147 | SEQ ID NO: 28 | SEQ ID NO: 119 | NP_000595_1-368_17939658_233-464_C237S | FGFR1IIIc | R1Mut2 | del MTSPLYLEGS |
| HG1020149 | SEQ ID NO: 29 | SEQ ID NO: 120 | NP_000595_1-367_17939658_233-464_C237S | FGFR1IIIc | R1Mut3 | del VMTSPLYLEGS |
| HG1020150 | SEQ ID NO: 30 | SEQ ID NO: 121 | NP_000595_1-362_17939658_233-464_C237S | FGFR1IIIc | R1Mut4 | del EERPAVMTSPLYLEGS |

TABLE 1-continued

SEQ ID NOS and Protein Identification

| Patent ID | SEQ. ID. NO. (N1) | SEQ. ID. NO. (P1) | Protein ID | Protein | Annotation | Description |
|---|---|---|---|---|---|---|
| HG1020151 | SEQ ID NO: 31 | SEQ ID NO: 122 | NP_000595_1-376_D366-D367_17939658_233-464_C237S | FGFR1IIIc | R1Mut7 | del PA |
| HG1020152 | SEQ ID NO: 32 | SEQ ID NO: 123 | NP_000595_1-376_P366G_17939658_233-464_C237S | FGFR1IIIc | R1Mut8 | P366G |
| HG1020153 | SEQ ID NO: 33 | SEQ ID NO: 124 | NP_000595_1-376_P366M_17939658_233-464_C237S | FGFR1IIIc | R1Mut9 | P366M |
| HG1020154 | SEQ ID NO: 34 | SEQ ID NO: 125 | NP_000595_1-376_M369N_17939658_233-464_C237S | FGFR1IIIc | R1Mut10 | M369N |
| HG1020155 | SEQ ID NO: 35 | SEQ ID NO: 126 | NP_000595_1-376_P366M_M369N_17939658_233-464_C237S | FGFR1IIIc | R1Mut11 | P366M M369N |
| HG1020157 | SEQ ID NO: 36 | SEQ ID NO: 127 | NP_056934_1-370 | FGFR1IIIc | R1Mut1 | del LYLEGS |
| HG1020156 | SEQ ID NO: 37 | SEQ ID NO: 128 | NP_056934_1-366 | FGFR1IIIc | R1Mut2 | del MTSPLYLEGS |
| HG1020158 | SEQ ID NO: 38 | SEQ ID NO: 129 | NP_056934_1-365 | FGFR1IIIc | R1Mut3 | del VMTSPLYLEGS |
| HG1020159 | SEQ ID NO: 39 | SEQ ID NO: 130 | NP_056934_1-360 | FGFR1IIIc | R1Mut4 | del EERPAVMTSPLYLEGS |
| HG1020160 | SEQ ID NO: 40 | SEQ ID NO: 131 | NP_056934_1-355 | FGFR1IIIc | R1Mut5 | del VLEALEERPAVMTSPLYLEGS |
| HG1020161 | SEQ ID NO: 41 | SEQ ID NO: 132 | NP_056934_1-374_D364-D365 | FGFR1IIIc | R1Mut7 | del PA |
| HG1020162 | SEQ ID NO: 42 | SEQ ID NO: 133 | NP_056934_1-374_P364G | FGFR1IIIc | R1Mut8 | P364G |
| HG1020163 | SEQ ID NO: 43 | SEQ ID NO: 134 | NP_056934_1-374_P364M | FGFR1IIIc | R1Mut9 | P364M |
| HG1020164 | SEQ ID NO: 44 | SEQ ID NO: 135 | NP_056934_1-374_M367N | FGFR1IIIc | R1Mut10 | M367N |
| HG1020165 | SEQ ID NO: 45 | SEQ ID NO: 136 | NP_056934_1-374_P364M_M367N | FGFR1IIIc | R1Mut11 | P364M M367N |
| HG1020167 | SEQ ID NO: 46 | SEQ ID NO: 137 | NP_075594_1-281 | FGFR1IIIc | R1Mut1 | del LYLEGS |
| HG1020166 | SEQ ID NO: 47 | SEQ ID NO: 138 | NP_075594_1-277 | FGFR1IIIc | R1Mut2 | del MTSPLYLEGS |
| HG1020168 | SEQ ID NO: 48 | SEQ ID NO: 139 | NP_075594_1-276 | FGFR1IIIc | R1Mut3 | del VMTSPLYLEGS |
| HG1020169 | SEQ ID NO: 49 | SEQ ID NO: 140 | NP_075594_1-271 | FGFR1IIIc | R1Mut4 | del EERPAVMTSPLYLEGS |
| HG1020170 | SEQ ID NO: 50 | SEQ ID NO: 141 | NP_075594_1-285_D275-D276 | FGFR1IIIc | R1Mut7 | del PA |
| HG1020171 | SEQ ID NO: 51 | SEQ ID NO: 142 | NP_075594_1-285_P275G | FGFR1IIIc | R1Mut8 | P275G |
| HG1020172 | SEQ ID NO: 52 | SEQ ID NO: 143 | NP_075594_1-285_P275M | FGFR1IIIc | R1Mut9 | P275M |
| HG1020173 | SEQ ID NO: 53 | SEQ ID NO: 144 | NP_075594_1-285_M278N | FGFR1IIIc | R1Mut10 | M278N |
| HG1020174 | SEQ ID NO: 54 | SEQ ID NO: 145 | NP_075594_1-285_P275M_M278N | FGFR1IIIc | R1Mut11 | P275M M278N |
| HG1020176 | SEQ ID NO: 55 | SEQ ID NO: 146 | NP_000595_1-372 | FGFR1IIIc | R1Mut1 | del LYLEGS |
| HG1020175 | SEQ ID NO: 56 | SEQ ID NO: 147 | NP_000595_1-368 | FGFR1IIIc | R1Mut2 | del MTSPLYLEGS |
| HG1020177 | SEQ ID NO: 57 | SEQ ID NO: 148 | NP_000595_1-367 | FGFR1IIIc | R1Mut3 | del VMTSPLYLEGS |
| HG1020178 | SEQ ID NO: 58 | SEQ ID NO: 149 | NP_000595_1-362 | FGFR1IIIc | R1Mut4 | del EERPAVMTSPLYLEGS |
| HG1020179 | SEQ ID NO: 59 | SEQ ID NO: 150 | NP_000595_1-376_D366-D367 | FGFR1IIIc | R1Mut7 | del PA |
| HG1020180 | SEQ ID NO: 60 | SEQ ID NO: 151 | NP_000595_1-376_P366G | FGFR1IIIc | R1Mut8 | P366G |
| HG1020181 | SEQ ID NO: 61 | SEQ ID NO: 152 | NP_000595_1-376_P366M | FGFR1IIIc | R1Mut9 | P366M |
| HG1020182 | SEQ ID NO: 62 | SEQ ID NO: 153 | NP_000595_1-376_M369N | FGFR1IIIc | R1Mut10 | M369N |

TABLE 1-continued

SEQ ID NOS and Protein Identification

| Patent ID | SEQ. ID. NO. (N1) | SEQ. ID. NO. (P1) | Protein ID | Protein | Annotation | Description |
|---|---|---|---|---|---|---|
| HG1020183 | SEQ ID NO: 63 | SEQ ID NO: 154 | NP_000595_1-376_P366M_M369N | FGFR1IIIc | R1Mut11 | P366M M369N |
| HG1020184 | SEQ ID NO: 64 | SEQ ID NO: 155 | 182571_1-369 | FGFR4 | FGFR4 ECD | |
| HG1020185 | SEQ ID NO: 65 | SEQ ID NO: 156 | 182571_1-369_17939658_233-464_C237S | FGFR4 | FGFR4 ECD + linker + Fc | parental construct |
| HG1021610 | SEQ ID NO: 66 | SEQ ID NO: 157 | 182571_1-369_nolinker_17939658_233-464_C237S | FGFR4 | FGFR4 ECD + Fc | no linker |
| HG1020186 | SEQ ID NO: 67 | SEQ ID NO: 158 | 13991618_1-159 | FGFR4 | other FGFR4 ECD | |
| HG1020187 | SEQ ID NO: 68 | SEQ ID NO: 159 | NP_002002_1-369 | FGFR4 | other FGFR4 ECD | |
| HG1020188 | SEQ ID NO: 69 | SEQ ID NO: 160 | 31372_1-369 | FGFR4 | other FGFR4 ECD | |
| HG1020189 | SEQ ID NO: 70 | SEQ ID NO: 161 | 2832350_1-369 | FGFR4 | other FGFR4 ECD | |
| HG1021616 | SEQ ID NO: 71 | SEQ ID NO: 162 | 182571_1-364_17939658_233-464_C237S | FGFR4 | R4Mut1 | del ARYTD |
| HG1021617 | SEQ ID NO: 72 | SEQ ID NO: 163 | 182571_1-359_17939658_233-464_C237S | FGFR4 | R4Mut2 | del AAAPEARYTD |
| HG1021618 | SEQ ID NO: 73 | SEQ ID NO: 164 | 182571_1-354_17939658_233-464_C237S | FGFR4 | R4Mut3 | del DPTWTAAAPEARYTD |
| HG1021619 | SEQ ID NO: 74 | SEQ ID NO: 165 | 182571_1-352_17939658_233-464_C237S | FGFR4 | R4Mut4 | del EEDPTWTAAAPEARYTD |
| HG1021620 | SEQ ID NO: 75 | SEQ ID NO: 166 | 182571_1-351_17939658_233-464_C237S | FGFR4 | R4Mut5 | del PEEDPTWTAAAPEARYTD |
| HG1020190 | SEQ ID NO: 76 | SEQ ID NO: 167 | NP_056934_1-19 | FGFR1 | leader seq for FGFR1 (all three variants) | |
| HG1020191 | SEQ ID NO: 77 | SEQ ID NO: 168 | 182571_1-19 | FGFR4 | leader seq for FGFR4 | |
| HG1020192 | SEQ ID NO: 78 | SEQ ID NO: 169 | 2832350_1-21 | FGFR4 | leader seq for FGFR4 | |
| HG1020118 | SEQ ID NO: 79 | SEQ ID NO: 170 | linker_sequence | linker | | |
| HG1020119 | SEQ ID NO: 80 | SEQ ID NO: 171 | 17939658_233-464_C237S | Fc | | |
| HG1020120 | SEQ ID NO: 81 | SEQ ID NO: 172 | 34528298_241-468 | Fc | | |
| HG1020121 | SEQ ID NO: 82 | SEQ ID NO: 173 | 19684073_245-473 | Fc | | |
| HG1020374 | SEQ ID NO: 83 | SEQ ID NO: 174 | NP_000133_1-375 | FGFR3IIIc | ECD only | FGFR3IIIc |
| HG1020375 | SEQ ID NO: 84 | SEQ ID NO: 175 | NP_075254_1-310 | FGFR3IIIc | ECD only | |
| HG1021603 | SEQ ID NO: 85 | SEQ ID NO: 176 | NP_000133_1-375_GS_17939658_233-464_C237S | FGFR3IIIc | FGFR3IIIc + GS + Fc | with linker |
| HG1021604 | SEQ ID NO: 86 | SEQ ID NO: 177 | NP_000133_1-375_17939658_233-464_C237S | FGFR3IIIc | FGFR3IIIc + Fc | no linker |
| HG1021605 | SEQ ID NO: 87 | SEQ ID NO: 178 | NP_000133_1-371_17939658_233-464_C237S | FGFR3IIIc | R3Mut1 | del VYAGGS |
| HG1021606 | SEQ ID NO: 88 | SEQ ID NO: 179 | NP_000133_1-367_17939658_233-464_C237S | FGFR3IIIc | R3Mut2 | del EAGSVYAGGS |
| HG1021607 | SEQ ID NO: 89 | SEQ ID NO: 180 | NP_000133_1-366_17939658_233-464_C237S | FGFR3IIIc | R3Mut3 | del DEAGSVYAGGS |
| HG1021608 | SEQ ID NO: 90 | SEQ ID NO: 181 | NP_000133_1-361_17939658_233-464_C237S | FGFR3IIIc | R3Mut4 | del ELVEADEAGSVYAGGS |
| HG1021609 | SEQ ID NO: 91 | SEQ ID NO: 182 | NP_000133_1-355_17939658_233-464_C237S | FGFR3IIIc | R3Mut5 | del VLPAEEELVEADEAGSVYAGGS |

TABLE 1-continued

SEQ ID NOS and Protein Identification

| Patent ID | SEQ. ID. NO. (N1) | SEQ. ID. NO. (P1) | Protein ID | Protein | Annotation | Description |
|---|---|---|---|---|---|---|
| HG1021621 | SEQ ID NO: 183 | SEQ ID NO: 197 | NP_056934_1-374 | FGFR1IIIb | ECD only | |
| HG1021622 | SEQ ID NO: 184 | SEQ ID NO: 198 | FGFR1IIIb_1-374_17939658_233-464_C237S | FGFR1IIIb | ECD + Fc | no linker |
| HG1021623 | SEQ ID NO: 185 | SEQ ID NO: 199 | FGFR1IIIb_1-370_17939658_233-464_C237S | FGFR1IIIb | R1Mut1 | del LYLE |
| HG1021624 | SEQ ID NO: 186 | SEQ ID NO: 200 | FGFR1IIIb_1-366_17939658_233-464_C237S | FGFR1IIIb | R1Mut2 | del MTSPLYLE |
| HG1021625 | SEQ ID NO: 187 | SEQ ID NO: 201 | FGFR1IIIb_1-365_17939658_233-464_C237S | FGFR1IIIb | R1Mut3 | del VMTSPLYLE |
| HG1021626 | SEQ ID NO: 188 | SEQ ID NO: 202 | FGFR1IIIb_1-361_17939658_233-464_C237S | FGFR1IIIb | R1Mut4 | del ERPAVMTSPLYLE |
| HG1021627 | SEQ ID NO: 189 | SEQ ID NO: 203 | FGFR1IIIb_1-355_17939658_233-464_C237S | FGFR1IIIb | R1Mut5 | del VLEALEERPAVMTSPLYLE |
| HG1021628 | SEQ ID NO: 190 | SEQ ID NO: 204 | P22607_1-375 | FGFR3IIIb | ECD only | |
| HG1021629 | SEQ ID NO: 191 | SEQ ID NO: 205 | P22607_1-375_17939658_233-464_C237S | FGFR3IIIb | ECD + Fc | no linker |
| HG1021630 | SEQ ID NO: 192 | SEQ ID NO: 206 | P22607_1-371_17939658_233-464_C237S | FGFR3IIIb | R3Mut1 | del VYAG |
| HG1021631 | SEQ ID NO: 193 | SEQ ID NO: 207 | P22607_1-367_17939658_233-464_C237S | FGFR3IIIb | R3Mut2 | del EAGSVYAG |
| HG1021632 | SEQ ID NO: 194 | SEQ ID NO: 208 | P22607_1-366_17939658_233-464_C237S | FGFR3IIIb | R3Mut3 | del DEAGSVYAG |
| HG1021633 | SEQ ID NO: 195 | SEQ ID NO: 209 | P22607_1-362_17939658_233-464_C237S | FGFR3IIIb | R3Mut4 | del LVEADEAGSVYAG |
| HG1021634 | SEQ ID NO: 196 | SEQ ID NO: 210 | P22607_1-355_17939658_233-464_C237S | FGFR3IIIb | R3Mut5 | del VLPAEEELVEADEAGSVYAG |
| HG1021635 | SEQ ID NO: 211 | SEQ ID NO: 227 | 15281415_1-378 | FGFR2b | ECD only | |
| HG1021636 | SEQ ID NO: 212 | SEQ ID NO: 228 | 15281415_1-378_17939658_233-464_C237S | FGFR2b | ECD + Fc | |
| HG1021637 | SEQ ID NO: 213 | SEQ ID NO: 229 | 15281415_1-378_GS_17939658_233-464_C237S | FGFR2b | ECD + GS + Fc | |
| HG1021638 | SEQ ID NO: 214 | SEQ ID NO: 230 | 15281415_1-374_17939658_233-464_C237S | FGFR2b | R2Mut1 | del DYLE |
| HG1021639 | SEQ ID NO: 215 | SEQ ID NO: 231 | 15281415_1-370_17939658_233-464_C237S | FGFR2b | R2Mut2 | del TASPDYLE |
| HG1021640 | SEQ ID NO: 216 | SEQ ID NO: 232 | 15281415_1-369_17939658_233-464_C237S | FGFR2b | R2Mut3 | del ITASPDYLE |
| HG1021641 | SEQ ID NO: 217 | SEQ ID NO: 233 | 15281415_1-365_17939658_233-464_C237S | FGFR2b | R2Mut4 | del REKEITASPDYLE |
| HG1021642 | SEQ ID NO: 218 | SEQ ID NO: 234 | 15281415_1-356_17939658_233-464_C237S | FGFR2b | R2Mut5 | del VLPKQQAPGREKEITASPDYLE |
| HG1021643 | SEQ ID NO: 219 | SEQ ID NO: 235 | NP_000132_1-377 | FGFR2c | ECD only | |
| HG1021644 | SEQ ID NO: 220 | SEQ ID NO: 236 | NP_000132_1-377_17939658_233-464_C237S | FGFR2c | ECD + Fc | |
| HG1021645 | SEQ ID NO: 221 | SEQ ID NO: 237 | NP_000132_1-377_GS_17939658_233-464_C237S | FGFR2c | ECD + GS + Fc | |
| HG1021646 | SEQ ID NO: 222 | SEQ ID NO: 238 | NP_000132_1-373_17939658_233-464_C237S | FGFR2c | R2Mut1 | del DYLE |

TABLE 1-continued

SEQ ID NOS and Protein Identification

| Patent ID | SEQ. ID. NO. (N1) | SEQ. ID. NO. (P1) | Protein ID | Protein | Annotation | Description |
|---|---|---|---|---|---|---|
| HG1021647 | SEQ ID NO: 223 | SEQ ID NO: 239 | NP_000132_1-369_17939658_233-464_C237S | FGFR2c | R2Mut2 | del TASPDYLE |
| HG1021648 | SEQ ID NO: 224 | SEQ ID NO: 240 | NP_000132_1-368_17939658_233-464_C237S | FGFR2c | R2Mut3 | del ITASPDYLE |
| HG1021649 | SEQ ID NO: 225 | SEQ ID NO: 241 | NP_000132_1-364_17939658_233-464_C237S | FGFR2c | R2Mut4 | del REKEITASPDYLE |
| HG1021650 | SEQ ID NO: 226 | SEQ ID NO: 242 | NP_000132_1-358_17939658_233-464_C237S | FGFR2c | R2Mut5 | del VLPAPGREKEIT ASPDYLE |
| HG1021651 | | SEQ ID NO: 243 | R1_delfragment_1 | FGFR1 | deleted fragment | LYLE |
| HG1021652 | | SEQ ID NO: 244 | R1_delfragment_2 | FGFR1 | deleted fragment | PLYLE |
| HG1021653 | | SEQ ID NO: 245 | R1_delfragment_3 | FGFR1 | deleted fragment | MTSPLYLE |
| HG1021654 | | SEQ ID NO: 246 | R1_delfragment_4 | FGFR1 | deleted fragment | AVMTSPLYLE |
| HG1021655 | | SEQ ID NO: 247 | R1_delfragment_5 | FGFR1 | deleted fragment | VMTSPLYLE |
| HG1021656 | | SEQ ID NO: 248 | R1_delfragment_6 | FGFR1 | deleted fragment | EERPAVMTSPL YLE |
| HG1021657 | | SEQ ID NO: 249 | R1_delfragment_7 | FGFR1 | deleted fragment | LEERPAVMTSP LYLE |
| HG1021658 | | SEQ ID NO: 250 | R1_delfragment_8 | FGFR1 | deleted fragment | KALEERPAVMT SPLYLE |
| HG1021659 | | SEQ ID NO: 251 | R1_delfragment_9 | FGFR1 | deleted fragment | EALEERPAVMT SPLYLE |
| HG1021660 | | SEQ ID NO: 252 | R1_delfragment_10 | FGFR1 | deleted fragment | RPVAKALEERP AVMTSPLYLE |
| HG1021661 | | SEQ ID NO: 253 | R2_delfragment_1 | FGFR2 | deleted fragment | DYLE |
| HG1021662 | | SEQ ID NO: 254 | R2_delfragment_2 | FGFR2 | deleted fragment | PDYLE |
| HG1021663 | | SEQ ID NO: 255 | R2_delfragment_3 | FGFR2 | deleted fragment | TASPDYLE |
| HG1021664 | | SEQ ID NO: 256 | R2_delfragment_4 | FGFR2 | deleted fragment | ITASPDYLE |
| HG1021665 | | SEQ ID NO: 257 | R2_delfragment_5 | FGFR2 | deleted fragment | EITASPDYLE |
| HG1021666 | | SEQ ID NO: 258 | R2_delfragment_6 | FGFR2 | deleted fragment | GREKEITASPDY LE |
| HG1021667 | | SEQ ID NO: 259 | R2_delfragment_7 | FGFR2 | deleted fragment | PGREKEITASPD YLE |
| HG1021668 | | SEQ ID NO: 260 | R2_delfragment_8 | FGFR2 | deleted fragment | APGREKEITASP DYLE |
| HG1021669 | | SEQ ID NO: 261 | R2_delfragment_9 | FGFR2 | deleted fragment | PAPGREKEITAS PDYLE |
| HG1021670 | | SEQ ID NO: 262 | R2_delfragment_10 | FGFR2 | deleted fragment | QAPGREKEITAS PDYLE |
| HG1021671 | | SEQ ID NO: 263 | R2_delfragment_11 | FGFR2 | deleted fragment | PKQQAPGREKEI TASPDYLE |
| HG1021672 | | SEQ ID NO: 264 | R3_delfragment_1 | FGFR3 | deleted fragment | VYAG |
| HG1021673 | | SEQ ID NO: 265 | R3_delfragment_2 | FGFR3 | deleted fragment | SVYAG |
| HG1021674 | | SEQ ID NO: 266 | R3_delfragment_3 | FGFR3 | deleted fragment | EAGSVYAG |
| HG1021675 | | SEQ ID NO: 267 | R3_delfragment_4 | FGFR3 | deleted fragment | DEAGSVYAG |
| HG1021676 | | SEQ ID NO: 268 | R3_delfragment_5 | FGFR3 | deleted fragment | ADEAGSVYAG |
| HG1021677 | | SEQ ID NO: 269 | R3_delfragment_6 | FGFR3 | deleted fragment | ELVEADEAGSV YAG |
| HG1021678 | | SEQ ID NO: 270 | R3_delfragment_7 | FGFR3 | deleted fragment | EELVEADEAGS VYAG |
| HG1021679 | | SEQ ID NO: 271 | R3_delfragment_8 | FGFR3 | deleted fragment | AEEELVEADEA GSVYAG |
| HG1021680 | | SEQ ID NO: 272 | R3_delfragment_9 | FGFR3 | deleted fragment | PAEEELVEADE AGSVYAG |
| HG1021681 | | SEQ ID NO: 273 | R3_delfragment_10 | FGFR3 | deleted fragment | GPRAAEEELVE ADEAGSVYAG |

TABLE 1-continued

SEQ ID NOS and Protein Identification

| Patent ID | SEQ. ID. NO. (N1) | SEQ. ID. NO. (P1) | Protein ID | Protein | Annotation | Description |
|---|---|---|---|---|---|---|
| HG1021682 | | SEQ ID NO: 274 | R4_delfragment_1 | FGFR4 | deleted fragment | RYTD |
| HG1021683 | | SEQ ID NO: 275 | R4_delfragment_2 | FGFR4 | deleted fragment | ARYTD |
| HG1021684 | | SEQ ID NO: 276 | R4_delfragment_3 | FGFR4 | deleted fragment | APEARYTD |
| HG1021685 | | SEQ ID NO: 277 | R4_delfragment_4 | FGFR4 | deleted fragment | AAPEARYTD |
| HG1021686 | | SEQ ID NO: 278 | R4_delfragment_5 | FGFR4 | deleted fragment | AAAPEARYTD |
| HG1021687 | | SEQ ID NO: 279 | R4_delfragment_6 | FGFR4 | deleted fragment | PTWTAAAPEARYTD |
| HG1021688 | | SEQ ID NO: 280 | R4_delfragment_7 | FGFR4 | deleted fragment | DPTWTAAAPEARYTD |
| HG1021689 | | SEQ ID NO: 281 | R4_delfragment_8 | FGFR4 | deleted fragment | EEDPTWTAAAPEARYTD |
| HG1021690 | | SEQ ID NO: 282 | R4_delfragment_9 | FGFR4 | deleted fragment | PEEDPTWTAAAPEARYTD |

Table 2 shows information characterizing sequences relating to full-length FGFR1, FGFR3, and FGFR4 proteins. Column 1 shows the NCBI accession number (Protein ID). Column 2 designates whether the sequence relates to FGFR1, FGFR3, or FGFR4. Column 3 shows the predicted length of the polypeptide encoded by each protein (Protein Length). Column 4 (Treevote) shows the result of an algorithm that predicts whether the predicted amino acid sequence is secreted. A Treevote at or near 0 indicates a low probability that the protein is secreted while a Treevote at or near 1.00 indicates a high probability that the protein is secreted. Column 5 shows the predicted signal peptide coordinates (Signal Peptide Coords). Column 6 shows the mature protein coordinates, which refer to the coordinates of the amino acid residues of the mature polypeptide after cleavage of the secretory leader or signal peptide sequence (Mature Protein Coords). Column 7 shows alternate predictions of the signal peptide coordinates (Altern Signal Peptide Coords). Column 8 specifies the coordinates of an alternative form of the mature protein (Altern Mature Protein Coords). The alternate coordinates result from alternative predictions of the signal peptide cleavage site; their presence may, for example, depend on the host used to express the polypeptides. Column 9 specifies the number of transmembrane domains (TM). Columns 10 and 11 provide the coordinates of the transmembrane and non-transmembrane sequences of the polypeptides. The transmembrane coordinates (TM Coords) designate the transmembrane domains of the molecule. The non-transmembrane coordinates (non-TM Coords) refer to the protein segments not located in the membrane; these can include extracellular, cytoplasmic, and luminal sequences. Coordinates are listed in terms of the amino acid residues beginning with "1" for the first amino acid residue at the N-terminus of the full-length polypeptide.

TABLE 2

Characterization of FGFR Sequences

| Protein ID | Protein | Protein Length | Treevote | Signal Peptide Coords | Mature Protein Coords | Altern Signal Peptide Coords | Altern Mature Protein Coords | TM | TM Coords | Non-TM Coords |
|---|---|---|---|---|---|---|---|---|---|---|
| NP_056934 | FGFR1 | 820 | 0 | (1-19) | (20-820) | (11-23) (9-21) | (24-820) (22-820) | 1 | (373-395) | (1-372) (396-820) |
| NP_075594 | FGFR1 | 731 | 0 | (1-19) | (20-731) | (11-23) (9-21) | (24-731) (22-731) | 1 | (284-306) | (1-283) (307-310) |
| NP_000595 | FGFR1 | 822 | 0 | (1-19) | (20-822) | (11-23) (9-21) | (24-822) (22-822) | 1 | (375-397) | (1-374) (398-822) |
| NP_075254 | FGFR3 | 694 | 0.93 | (1-19) | (20-694) | (3-15) (8-20) (10-22) | (16-694) (21-694) (23-694) | 0 | | (1-694) |
| NP_000133 | FGFR3 | 806 | 0.03 | (1-19) | (20-806) | (3-15) (8-20) (10-22) | (16-806) (21-806) (23-806) | 2 | (373-395) (537-559) | (1-372) (396-536) (560-806) |
| FGFR3-IIIc-Fc | FGFR3 | 606 | 0.99 | (1-16) | (17-606) | (8-20) (6-18) (3-15) (2-14) | (21-606) (19-606) (16-606) (15-606) | 0 | (370-392) | (1-606) |
| 182571 | FGFR4 | 802 | 0.99 | (1-18) | (19-802) | (1-13) (4-16) (3-15) | (14-802) (17-802) (16-802) | 0 | | (1-802) |
| 13991618 | FGFR4 | 592 | 0 | | (1-592) | | | 0 | | (1-592) |
| NP_002002 | FGFR4 | 802 | 1 | (1-18) | (19-802) | (1-13) (4-16) (3-15) | (14-802) (17-802) (16-802) | 0 | | (1-802) |

TABLE 2-continued

Characterization of FGFR Sequences

| Protein ID | Protein | Protein Length | Treevote | Signal Peptide Coords | Mature Protein Coords | Altern Signal Peptide Coords | Altern Mature Protein Coords | TM | TM Coords | Non-TM Coords |
|---|---|---|---|---|---|---|---|---|---|---|
| 2832350 | FGFR4 | 802 | 0.98 | (1-18) | (19-802) | (1-13) (3-15) (4-16) | (14-802) (16-802) (17-802) | 0 | | (1-802) |
| 31372 | FGFR4 | 802 | 1 | (1-18) | (19-802) | (1-13) (4-16) (3-15) | (14-802) (17-802) (16-802) | 0 | | (1-802) |

Nucleic Acid Molecules Encoding FGFR Fusion Molecules

The present invention provides nucleic acid molecules that comprise polynucleotide sequences that encode the FGFR fusion proteins of the invention. These nucleic acid molecules can be constructed with recombinant DNA techniques conventional in the art. The nucleic acid molecules include molecules relevant to the FGFR1-IIIb ECD, such as those provided in SEQ ID NOS: 183-189; those relevant to FGFR1-IIIc ECD, such as those provided in SEQ ID NOS: 1-63; those relevant to FGFR2-IIIb ECD, such as those provided in SEQ ID NOS: 211-218; those relevant to FGFR2-IIIc ECD, such as those provided in SEQ ID NOS: 219-226; those relevant to FGFR3-IIIb ECD, such as those provided in SEQ ID NOS: 190-196; those relevant to FGFR3-IIIc ECD, such as those provided in SEQ ID NOS: 83-91; and those relevant to FGFR4 ECD, such as those provided in SEQ ID NOS: 64-78.

The nucleic acid molecules of the invention can include polynucleotide sequences that encode all or part of the ECD of an FGFR polypeptide, with or without its native homologous secretory leader sequence. If a homologous secretory leader sequence is not used in the construction of the nucleic acid molecule, then another secretory leader sequence may be used, for example, any one of the leader sequences described in PCT US06/02951.

Typically, the nucleic acid molecule encoding the gene of interest, the FGFR ECD, is inserted into an expression vector, suitable for expression in a selected host cell, at a linker site and the nucleic acid molecule encoding the fusion partner is inserted at the site following the FGFR ECD such that they are in-frame when the nucleic acid molecule is transcribed and translated.

FGFR Fusion Molecule Expression and Production

Vectors

The invention provides genetically engineered recombinant vectors comprising nucleic acid molecules encoding the fusion proteins of the invention, recombinant host cells comprising the recombinant vectors, the nucleic acid molecules encoding the fusion proteins of the invention, and the production of FGFR fusion proteins and fragments thereof. Vectors of the invention include those that are suitable for expression in a selected host, whether prokaryotic or eukaryotic, for example, phage, plasmid, and viral vectors. Viral vectors may be either replication competent or replication defective retroviral vectors. Viral propagation generally will occur only in complementing host cells comprising replication defective vectors. Vectors of the invention may comprise Kozak sequences (Lodish et al., *Molecular Cell Biology*, 4$^{th}$ ed., 1999) and may also contain the ATG start codon of an FGFR extracellular domain. Vectors of the invention include "minicircle" vectors, which are described in greater detail below.

Copy number and positional effects are considered in designing transiently and stably expressed vectors. Copy number can be increased by, for example, dihydrofolate reductase amplification. Positional effects can be optimized by, for example, Chinese hamster elongation factor-1 vector pDEF38 (CHEF1), ubiquitous chromatin opening elements (UCOE), scaffold/matrix-attached region of human (S/MAR), and artificial chromosome expression (ACE) vectors, as well as by using site-specific integration methods known in the art. The expression constructs containing the vector and gene of interest will further contain sites for transcription initiation, termination, and, in the transcribed region, a ribosome binding site for translation. The coding portion of the transcripts expressed by the constructs can include a translation initiating codon at the beginning and a termination codon (UAA, UGA, or UAG) appropriately positioned at the end of the polypeptide to be translated.

Considering the above-mentioned factors, vectors suitable for expressing FGFR fusion molecules in bacteria include pTT vectors, available from Biotechnology Research Institute (Montreal, Canada), pQE70, pQE60, and pQE-9, available from Qiagen (Mississauga, Ontario, Canada); vectors derived from pcDNA3, available from Invitrogen (Carlsbad, Calif.); pBS vectors, Phagescript vectors, Bluescript vectors, pNH8A, pNH6a, pNH18A, pNH46A, available from Stratagene (La Jolla, Calif.); and ptrc99a, pKK223-3, pKK233-3, pDR540, pRIT5 available from Pharmacia (Peapack, N.J.). Among suitable eukaryotic vectors are pWLNEO, pSV2CAT, pOG44, pXT1, and pSG available from Stratagene (La Jolla, Calif.); and pSVK3, pBPV, pMSG and pSVL, available from Pharmacia (Peapack, N.J.).

Vectors for expressing FGFR fusion molecules include those comprising a pTT vector backbone (Durocher et al., *Nucl. Acids Res.* 30:E9 (2002)). Briefly, the backbone of a pTT vector may be prepared by obtaining pIRESpuro/EGFP (pEGFP) and pSEAP basic vector(s), for example from Clontech (Palo Alto, Calif.), and pcDNA3.1, pcDNA3.1/Myc-(His)$_6$ and pCEP4 vectors can be obtained from, for example, invitrogen (Carlsbad, Calif.). As used herein, the pTT5 backbone vector can generate a pTT5-Gateway vector and be used to transiently express proteins in mammalian cells. The pTT5 vector can be derivatized to pTT5-A, pTT5-B, pTT5-D, pTT5-E, pTT5-H, and pTT5-I, for example. As used herein, the pTT2 vector can generate constructs for stable expression in mammalian cell lines.

A pTT vector can be prepared by deleting the hygromycin (BsmI and SalI excision followed by fill-in and ligation) and EBNA1 (ClaI and NsiI excision followed by fill-in and ligation) expression cassettes. The ColEI origin (FspI-SalI fragment, including the 3' end of the β-lactamase open reading frame (ORF) can be replaced with a FspI-SalI fragment from pcDNA3.1 containing the pMBI origin (and the same 3' end of β-lactamase ORF). A Myc-(His)$_6$ C-terminal fusion tag can be added to SEAP (HindIII-HpaI fragment from pSEAP-basic) following in-frame ligation in pcDNA3.1/Myc-His digested with HindIII and EcoRV. Plasmids can subsequently be amplified in *E. coli* (DH5α) grown in LB medium and purified using MAXI prep columns (Qiagen, Mississauga, Ontario, Canada). To quantify, plasmids can be subsequently diluted in, for example, 50 mM Tris-HCl pH 7.4 and absorbencies can be measured at 260 nm and 280 nm. Plasmid preparations with $A_{260}/A_{280}$ ratios between about 1.75 and about 2.00 are suitable for producing the FGFR constructs.

The expression vector pTT5 allows for extrachromosomal replication of the cDNA driven by a cytomegalovirus (CMV) promoter. The plasmid vector pCDNA-pDEST40 is a Gateway-adapted vector which can utilize a CMV promoter for high-level expression. SuperGlo GFP variant (sgGFP) can be obtained from Q-Biogene (Carlsbad, Calif.). Preparing a pCEP5 vector can be accomplished by removing the CMV promoter and polyadenylation signal of pCEP4 by sequential digestion and self-ligation using SalI and XbaI enzymes resulting in plasmid pCEP4A. A GbIII fragment from pAd-CMV5 (Massie et al., *J. Virol.* 72:2289-2296 (1998)), encoding the CMV5-poly(A) expression cassette ligated in BglII-linearized pCEP4Δ, resulting in the pCEP5 vector.

Vectors for expressing FGFR fusion molecules can include those comprising vectors optimized for use in CHO-S or CHO-S-derived cells, such as pDEF38 (CHEF1) and similar vectors (Running Deer et al., *Biotechnol. Prog.* 20:880-889 (2004). The CHEF vectors contain DNA elements that lead to high and sustained expression in CHO cells and derivatives thereof. They may include, but are not limited to, elements that prevent the transcriptional silencing of transgenes.

FGFR polynucleotide vectors may be joined to a selectable marker for propagation in a host. Generally, a selectable marker allows the selection of transformed cells based on their ability to thrive in the presence or absence of a chemical or other agent that inhibits an essential cell function. The selectable markers confer a phenotype on a cell expressing the marker, so that the cell can be identified under appropriate conditions. Suitable markers, therefore, include genes coding for proteins which confer drug resistance or sensitivity thereto, impart color to, or change the antigenic characteristics of those cells transfected with a molecule encoding the selectable marker, when the cells are grown in an appropriate selective medium.

Suitable selectable markers include dihydrofolate reductase or G418 for neomycin resistance in eukaryotic cell culture; and tetracycline, kanamycin, or ampicillin resistance genes for culturing in *E. coli* and other bacteria. Suitable selectable markers also include cytotoxic markers and drug resistance markers, whereby cells are selected by their ability to grow on media containing one or more of the cytotoxins or drugs; auxotrophic markers, by which cells are selected for their ability to grow on defined media with or without particular nutrients or supplements, such as thymidine and hypoxanthine; metabolic markers for which cells are selected, for example, for ability to grow on defined media containing a defined substance, for example, an appropriate sugar as the sole carbon source; and markers which confer the ability of cells to form colored colonies on chromogenic substrates or cause cells to fluoresce.

As mentioned above, vectors for the expression of FGFR fusion proteins can also be constructed in proteins retroviral vectors. One such vector, the ROSA$^β$geo retroviral vector, which maps to mouse chromosome six, was constructed with the reporter gene in reverse orientation with respect to retroviral transcription, downstream of a splice acceptor sequence (U.S. Pat. No. 6,461,864; Zambrowicz et al., *Proc. Natl. Acad. Sci.* 94:3789-3794 (1997)). Infecting embryonic stem (ES) cells with ROSA$^β$geo retroviral vector resulted in the ROSA$^β$geo26 (ROSA26) mouse strain by random retroviral gene trapping in the ES cells.

A DNA insert comprising an FGFR fusion molecule can be operatively linked to an appropriate promoter, such as the phage lambda PL promoter; the *E. coli* lac, trp, phoA, and tac promoters; the SV40 early and late promoters; and promoters of retroviral LTRs. Suitable promoters also include the pCMV vector with an enhancer, pcDNA3.1; the pCMV vector with an enhancer and an intron, pCIneo; the pCMV vector with an enhancer, an intron, and a tripartate leader, pTT2, and CHEF1. Other suitable promoters will be known to the skilled artisan. The promoter sequences include the minimum number of bases or elements necessary to initiate transcription of a gene of interest at levels detectable above background. Within the promoter sequence may be a transcription initiation site, as well as protein binding domains (consensus sequences) responsible for the binding of RNA polymerase. Eukaryotic promoters of the invention will often, but not always, contain "TATA" boxes and "CAT" boxes.

The invention provides vectors for the in vivo expression of FGFR fusion molecules in animals, including humans, under the control of a promoter that functions in a tissue-specific manner. For example, promoters that drive the expression of FGFR fusion proteins of the invention may be liver-specific, as described in PCT/US06/00668.

A region of additional amino acids, particularly charged amino acids, may be added to the N-terminus of the polypeptide to improve stability and persistence in the host cell purification throughout and subsequent handling and storage. Also, amino acid moieties may be added to the polypeptide to facilitate purification. Such amino acids may or may not be removed prior to the final preparation of the polypeptide. The FGFR fusion proteins of the invention can be fused to marker sequences, such as a peptide, that facilitates purification of the fused polypeptide. The marker amino acid sequence may be a hexa-histidine peptide such as the tag provided in a pQE vector (Qiagen, Mississauga, Ontario, Canada), among others, many of which are commercially available. As described in Gentz et al., *Proc. Natl. Acad. Sci.* 86:821-824 (1989), for instance, hexa-histidine provides for convenient purification of the fusion protein. Another peptide tag useful for purification, the hemagglutinin HA tag, corresponds to an epitope derived from the influenza hemagglutinin protein (Wilson et al., *Cell* 37:767-778 (1984)). Any of the above markers can be engineered using the polynucleotides or the polypeptides of the present invention.

The expression constructs of the invention will further contain sites for transcription initiation, termination, and, in the transcribed region, a ribosome binding site for translation. The coding portion of the transcripts expressed by the constructs can include a translation initiating codon at the beginning and a termination codon (UAA, UGA, or UAG) appropriately positioned at the end of the polypeptide to be translated.

Host Cells

FGFR fusion proteins of the invention can be expressed by and produced from prokaryotic cells, such as bacterial cells and eukaryotic cells, such as fungal cells, plant cells, insect cells, and mammalian cells, according to procedures known in the art, for example, as shown in the examples and figures that follow. FGFR fusion proteins can be expressed by and produced from bacterial *E. coli* cells; Cos 7 cells; mammalian kidney epithelial 293 cells; and Chinese Hamster Ovary (CHO) cells, including CHO-S and DG44 cells, which are derived from CHO cells. They can also be produced in vivo in animals, engineered or transfected with the nucleic acid molecules encoding the fusion proteins. For example, mice injected with DNA encoding FGFR fusion molecules can express FGFR fusion molecules following tail vein transfection (TVT).

Introduction of the FGFR fusion proteins into the host cell can be accomplished by calcium phosphate transfection, DEAE-dextran mediated transfection, cationic lipid-mediated transfection, electroporation, transduction, infection, or other known methods. Such methods are described in many standard laboratory manuals, such as Sambrook et al., *Molecular Cloning, A Laboratory Manual.* 3$^{rd}$ ed. Cold Spring Harbor Laboratory Press (2001). FGFR fusion proteins of the invention can be transiently or stably transfected into the host cells, as described in greater detail below. FGFR fusion proteins of the invention can be purified from host cells grown either in adherent culture or in suspension, and, as shown in greater detail below, can retain the biological properties of FGFR.

Host cells of the invention can express proteins and polypeptides in accordance with conventional methods, the method depending on the purpose for expression. For large scale production of the protein, a unicellular organism, such as *E. coli, B. subtilis, S. cerevisiae*; insect cells in combination with baculovirus vectors; or cells of a higher organism such as vertebrates, for example mammalian 293 (including 293-6E), CHO (including DG44), or COS 7 cells, can be used as the expression host cells. In some situations, it is desirable to express eukaryotic genes in eukaryotic cells, where the encoded protein will benefit from native folding and post-translational modifications, such as glycosylation.

Accordingly, the invention provides a recombinant host cell that comprises nucleic acid molecules encoding the FGFR fusion proteins, vectors comprising such nucleic acid molecules, or FGFR fusion proteins and cultures containing such. These host cells may produce FGFR1, FGFR2, FGFR3, and FGFR4 fusion proteins of the invention. For example, they may produce FGFR-F$_c$ fusion proteins and variants and fragments thereof. The host cells may be suitable for transient transfection and for stable transfection. FGFR fusion proteins expressed by any of the methods described herein may be detected by methods known in the art.

The post-translational glycosylation of the fusion proteins of the invention may vary according to their production source, as described in greater detail below. The glycosylation profile of a protein can affect its properties and/or function. Accordingly, the invention provides recombinant FGFR fusion proteins with or without altered glycosylation profiles compared to the naturally-occurring forms. They may be produced in different host cells. For example, unglycosylated FGFR fusion proteins can be produced from *E. coli*. A form of glycosylated FGFR fusion protein can be produced in yeast cells, such as *Saccharomyces cerevisae* or *Pichia pastoris*, or fungal cells such as *Aspergillus*. A form of glycosylated FGFR fusion protein can be produced in plants, such as rice, wheat, oats, etc. form of glycosylated FGFR protein can be produced in mammalian cells, such as 293 cells or CHO cells or derivatives thereof. For example, the invention provides mutant constructs with additional arginine residues for the attachment of N-linked sugars. These constructs may comprise point mutations with arginine residues or may have larger substitutions with regions that include arginine residues. The invention also provides mutant constructs with omitted arginine residues. Glycosylation mutants of the invention can be made by altering the naturally-occurring sequences using methods known to those of skill in the art.

Recombinant host cells of the invention are cultured under conditions conventional in the art, including both inducible and non-inducible conditions. The FGFR fusion proteins may be made inside the cells, such as in inclusion bodies, for example, when the host cell is an *E. coli* cell, or they may be secreted into the cell culture, such as when the host cells are mammalian cells and the proteins are expressed using mammalian expression systems, for example, using a secretory leader sequence. The invention provides cell cultures comprising the FGFR fusion protein whether the FGFR fusion protein is present in the culture medium or residing inside the cells.

Purification of FGFR Fusion Proteins

The invention provides methods of purifying FGFR fusion proteins using a combination of techniques, each of which is conventional in the art. These techniques include, but are not limited to, the use of affinity matrices and hydrophobic interaction chromatography, for example, affinity chromatography. Suitable affinity ligands include any ligands of the FGFR extracellular domain or of the fusion partner, or antibodies thereto. For example, a Protein A, Protein G, Protein A/G, or an antibody affinity column may be used to bind to an Fc fusion partner to purify the FGFR fusion proteins. Antibodies to the FGFR portion of the fusion protein or to the fusion partner may also be used to purify the fusion protein. Hydrophobic interactive chromatography is also suitable for purifying FGFR fusion proteins of the invention. For example, a butyl or phenyl column may be used. Other methods of purification known to those skilled in the art may also be suitable for purifying the FGFR fusion molecules of the invention.

Protein A affinity chromatography may be used to purify FGFR fusion proteins of the invention comprising an Fc domain. Protein A is a cell wall component produced by several strains of *Staphylococcus aureus* and can be made in a recombinant fashion. It consists of a single polypeptide chain weighing approximately 42,000 daltons and contains little or no carbohydrate. Protein A binds specifically to the Fc region of most immunoglobulin molecules, including IgG (Sjoquist et al., *Eur. J. Biochem.* 29:572-578 (1972); Hjelm et al., *Eur. J. Biochem.* 57:395-403 (1975)).

Protein G affinity chromatography may also be used to purify FGFR fusion proteins of the invention comprising an Fc domain. Protein G is a bacterial cell wall protein produced by group G streptococci and can also be made in a recombinant fashion. Like Protein A, Protein G binds to most mammalian immunoglobulins, primarily through their Fc regions (Bjorck et al., *J. Immunol.* 133:969-974 (1984); Guss et al., *EMBO J.* 5:1567-1575 (1986) Åkerström et al., *J. Biol. Chem.* 261:10,240-10,247 (1986)). Affinity chromatography using chimeric Fc binding molecules may further be used to purify FGFR fusion proteins of the invention comprising an Fc domain. For example, Protein A/G is a genetically engineered protein that combines the IgG binding profiles of both Protein A and Protein G. Protein A/G is a gene fusion product, which can be secreted from, inter alia, nonpathogenic *Bacillus*. Protein A/G typically weighs approximately 50,000 daltons and was designed to contain four Fc binding domains from Protein A and two from Protein G (Sikkema, *Amer. Biotech. Lab.* 7:42 (1989); Eliasson et al., *J. Biol. Chem.* 263:4323-4327 (1988).

Hydrodynamic Tail Vein Transfection (TVT)

The invention provides expression of FGFR fusion proteins in animals, following a hydrodynamics-based procedure of tail vein injection (Liu, F. et al., *Gene Ther.* 6:1258-1266 (1999); U.S. Pat. No. 6,627,616; and Zhang et al., *Hum. Gene Ther.* 10:1735 (1999). This technique provides for production of the FGFR fusion protein in vivo after administering the nucleic acid molecule encoding the fusion protein produced in a mini-circle vector construct. Serum from such injected animals containing the fusion protein may be used to further characterize the protein, without first having to produce and purify the fusion protein from cell culture expression systems.

In an embodiment, the invention provides vectors comprising nucleic acid molecules encoding an FGFR fusion protein for administration to animals and FGFR fusion proteins made thereby, following hydrodynamic injection of minicircle DNA comprising such nucleic acid molecules. Vectors for injection can be constructed, for example, by the system described in Chen et al., *Mol. Ther.* 8:495-500 (2003) and U.S. Pat. Appl. No. 2004/0214329 A1. In brief, an expression cassette for an FGFR gene is flanked by attachment sites for a recombinase, which is expressed in an inducible fashion in a portion of the vector sequence outside of the expression cassette. Following recombination, the *E. coli* produce a minicircle vector comprising an expression cassette with an FGFR fusion protein gene. The vector as described in Chen et al. can be modified by inserting the nucleic acid molecule encoding the FGFR fusion protein following the intron present in the vector, instead of in the midst of the introns.

Minicircle DNA vectors can be prepared with plasmids similar to pBAD.φC31.hFIX and pBAD.φC31.RHB and used to transform *E. coli*. Recombinases known in the art, for example, lambda and cre, are useful in the minicircle vectors. The expression cassettes may contain sites for transcription initiation, termination, and, in the transcribed region, a ribosome binding site for translation. The coding portion of the transcripts expressed by the constructs can include a translation initiating codon at the beginning and a termination codon (UAA, UGA, or UAG) appropriately positioned at the end of the polypeptide to be translated. The plasmids may include at least one selectable marker, for example, dihydrofolate reductase, G418, or a marker of neomycin resistance for eukaryotic cell culture; and tetracycline, kanamycin, or ampicillin resistance genes for culturing in *E. coli* and other prokaryotic cell culture. The minicircle producing plasmids may include at least one origin of replication to allow for the multiplication of the vector in a suitable eukaryotic or a prokaryotic host cell. Origins of replication are known in the art, as described, for example, in Genes II, Lewin, B., ed., John Wiley & Sons, New York (1985). The FGFR fusion proteins produced from minicircles can also be fused to marker sequences, as described above.

Fusion Partners and Conjugates

Gene manipulation techniques have enabled the development and use of recombinant therapeutic proteins with fusion partners that impart desirable pharmacokinetic properties. FGFR polypeptides, including their immunogenic epitopes and other fragments, can be combined with heterologous molecules, resulting in therapeutically useful fusion molecules. The invention provides fusion molecules comprising the extracellular domain of any of FGFR1, FGFR2, FGFR3, and FGFR4. It provides fusion partners capable of imparting favorable pharmacokinetics and/or pharmacodynamics to the FGFR. In an embodiment, the invention provides a fusion molecule comprising all or a part of the extracellular domain of FGFR1-IIIb, FGFR1-IIIc, FGFR2-IIIb, FRFR2-IIIc, FGFR3-IIIb, FGFR3-IIIc, FGFR4, or fragments thereof and a fusion partner, such as an antibody Fc domain.

FGFRs are expressed in many normal tissues and many cell types express more than one FGFR. In view of this, it is not obvious how a therapeutic which targets FGFR can be devised to last long enough in the circulation of a treated subject without causing harm to the normal tissues.

Fusion molecules of the invention have an increased half-life in vivo, as compared to FGFR extracellular domains. The prolonged half-life of the FGFR fusion molecules described herein can require lower doses and a less-frequent dosing regimen than FGFRs alone. The resulting decreased fluctuation of FGFR serum levels can improve the safety and tolerability of FGFR therapeutics.

The fusion partner can be linked to the C-terminus of the FGFR, or, alternatively, the FGFR can be linked to the C-terminus of the fusion partner. The fusion partner may comprise a linker, for example, a peptide linker, which may or may not comprise an enzyme cleavage site. The fusion partner may also comprise a molecule that extends the in vivo half-life by imparting improved receptor binding to FGFR within an acidic intracellular compartment, for example, an acid endosome or a lysosome.

Fusion partners of the invention include polymers, polypeptides, lipophilic moieties, and succinyl groups. Examples of polypeptide fusion partners include serum albumin and the antibody Fc domain. Polymer fusion partners may comprise one or more polyethylene glycol moieties, branched or linear chains. Lipophilic fusion partners may increase the skin permeability of the fusion molecule.

Oligomerization Domain Fusion Proteins

Oligomerization offers functional advantages to a fusion protein, including multivalency, increased binding strength, and the combined function of different domains. These features are seen in natural proteins and may also be introduced by protein engineering. Accordingly, the invention provides an FGFR fusion molecule, wherein the fusion partner comprises an oligomerization domain, for example, a dimerization domain. Suitable oligomerization domains include coiled-coil domains, including alpha-helical coiled-coil domains; collagen domains; collagen-like domains, and dimeric immunoglobulin domains. Suitable coiled-coil polypeptide fusion partners of the invention include tetranectin coiled-coil domain, the coiled-coil domain of cartilage oligomeric matrix protein; angiopoietin coiled-coil domains; and leucine zipper domains. FGFR fusion molecules with collagen or collagen-like oligomerization domains as fusion partner may comprise, for example, those found in collagens, mannose binding lectin, lung surfactant proteins A and D, adiponectin, ficolin, conglutinin, macrophage scavenger receptor, and emilin.

Antibody Fc Domain Fusion Proteins

In an embodiment, the invention provides fusion molecules having an Fc immunoglobulin domain. The FGFR fusion proteins of the invention can comprise Fc, various domains of the constant regions of the heavy or light chains of mammalian immunoglobulins and/or the first two domains of the human CD4 polypeptide.

In an embodiment, the human Fc domain fusion partner comprises the entire Fc domain. In an embodiment it comprises one or more fragments of the Fc domain. For example, it may comprise a hinge and the CH2 and CH3 constant domains of a human IgG, for example, human IgG1, IgG2, or IgG4. The invention provides an FGFR fusion protein wherein the fusion partner is a variant Fc polypeptide or a fragment of a variant Fc polypeptide. The variant Fc may comprise a hinge, CH2, and CH3 domains of human IgG2 with a P331S mutation, as described in U.S. Pat. No. 6,900,292.

In an embodiment, a fusion protein of the invention may be a homodimeric protein linked through cysteine residues in the hinge region of IgG Fc, resulting in a molecule similar to an IgG molecule, but without CH1 domains and light chains.

Methods of making fusion proteins are well-known to the skilled artisan. In an embodiment, the Fc fusion partner of the invention comprises an amino acid sequence of any of SEQ ID NO: 171, SEQ ID NO: 172, and SEQ ID NO: 173.

Albumin Fusion Proteins

The invention provides an FGFR fusion molecule with an albumin fusion partner comprising albumin from human serum (human serum albumin or "HSA"), one or more fragments of albumin, a peptide that binds albumin, and/or a molecule that conjugates with a lipid or other molecule that binds albumin. In an embodiment, an FGFR-HSA fusion molecule may be prepared as described herein and as further described in U.S. Pat. No. 6,686,179 with respect to an interferon alpha-HSA fusion molecule.

Dimeric FGFR Fusion Proteins

The invention provides FGFR fusion proteins, wherein the fusion partner comprises an FGFR extracellular domain or active fragment thereof. For example, the fusion protein may comprise two FGFR1, FGFR2, FGFR3, or FGFR4 extracellular domains or biologically active fragments thereof. The fusion molecule may also comprise heterologous combinations of two different FGFR extracellular domains or biologically active fragments thereof, as described in greater detail above.

In an embodiment, the FGFR fusion protein comprises an extracellular domain of an FGFR and/or one of its active fragments and further comprises a fusion partner comprising a dimerization domain as well as an FGFR extracellular domain. When the fusion partner comprises a dimerization domain, such as an Fc domain or an active fragment thereof, the FGFR fusion protein expressed in a mammalian cell expression system may naturally form a dimer during the production process.

Fusion Proteins with Pegylated Moieties

In addition to the recombinant molecules described above, the invention provides an FGFR fusion molecule, wherein the fusion partner comprises a polymer, such as a polyethylene glycol (PEG) moiety. PEG moieties of the invention may be branched or linear chain polymers. In an embodiment, the present invention contemplates a chemically derivatized polypeptide which includes mono- or poly- (e.g., 2-4) PEG moieties. Pegylation may be carried out by any of the pegylation reactions known in the art. Methods for preparing a pegylated protein product are generally known in the art. Optimal reaction conditions will be determined on a case by case basis, depending on known parameters and the desired result.

There are a number of PEG attachment methods available to those skilled in the art, for example, EP 0 401 384; Malik et al., *Exp. Hematol.*, 20:1028-1035 (1992); Francis, *Focus on Growth Factors*, 3:4-10 (1992); EP 0 154 316; EP 0 401 384; WO 92/16221; WO 95/34326; and the other publications cited herein that relate to pegylation.

Pegylation may be performed via an acylation reaction or an alkylation reaction with a reactive polyethylene glycol molecule. Thus, protein products of the present invention include pegylated proteins wherein the PEG groups are attached via acyl or alkyl groups. Such products may be mono-pegylated or poly-pegylated (for example, those containing 2-6 or 2-5 PEG groups). The PEG groups are generally attached to the protein at the α- or ε-amino groups of amino acids, but it is also contemplated that the PEG groups could be attached to any amino group attached to the protein that is sufficiently reactive to become attached to a PEG group under suitable reaction conditions.

Pegylation by acylation generally involves reacting an active ester derivative of PEG with a polypeptide of the invention. For acylation reactions, the polymer(s) selected typically have a single reactive ester group. Any known or subsequently discovered reactive PEG molecule may be used to carry out the pegylation reaction. An example of a suitable activated PEG ester is PEG esterified to N-hydroxysuccinimide (NHS). As used herein, acylation is contemplated to include, without limitation, the following types of linkages between the therapeutic protein and a polymer such as PEG: amide, carbamate, urethane, and the like, see for example, Chamow, *Bioconjugate Chem.*, 5:133-140 (1994). Reaction conditions may be selected from any of those known in the pegylation art or those subsequently developed, but should avoid conditions such as temperature, solvent, and pH that would inactivate the polypeptide to be modified.

Pegylation by acylation will generally result in a poly-pegylated protein. The connecting linkage may be an amide. The resulting product may be substantially only (e.g., >95%) mono, di- or tri-pegylated. However, some species with higher degrees of pegylation may be formed in amounts which depend on the specific reaction conditions used. If desired, more purified pegylated species may be separated from the mixture (particularly unreacted species) by standard purification techniques, including among others, dialysis, salting-out, ultrafiltration, ion-exchange chromatography, gel filtration chromatography, and electrophoresis.

Pegylation by alkylation generally involves reacting a terminal aldehyde derivative of PEG with a polypeptide in the presence of a reducing agent. For the reductive alkylation reaction, the polymer(s) selected should have a single reactive aldehyde group. An exemplary reactive PEG aldehyde is polyethylene glycol propionaldehyde, which is water stable, or mono C1-C10 alkoxy or aryloxy derivatives thereof, see for example, U.S. Pat. No. 5,252,714.

Variant and Mutant Polypeptides

The FGFR fusion proteins of the invention can be made by protein engineering to improve or alter the native characteristics of FGFR fusion proteins. Recombinant DNA technology known to those skilled in the art can be used to create novel mutant proteins or "muteins," including single or multiple amino acid substitutions, deletions, and additions. Such modified polypeptides can possess properties desirable in a therapeutic agent, such as enhanced activity or increased stability. In addition, they may be purified in higher yields and be more water-soluble than the corresponding natural polypeptide, at least under certain purification and storage conditions.

FGFR ECD Mutants

As mentioned above, the invention provides polypeptide fusion molecules having one or more residues deleted from the amino and/or carboxyl terminus of the amino acid sequences of the FGFR extracellular domains. For example, the invention provides deletion mutations of FGFR extracellular domains with deletions in the C-terminal region. The invention provides deletion mutants missing one or more amino acids in the region N-terminally adjacent to the transmembrane domain.

Figure 2:
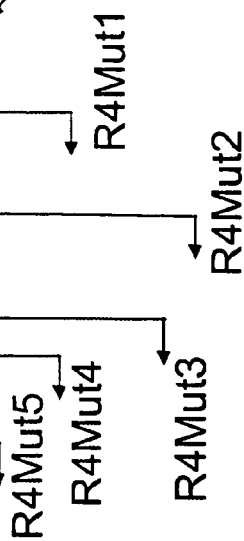
FIG. 2 shows the same amino acid sequence alignment as FIG. 1, denoting the truncation locations of the FGFR4 mutants R4Mut1, R4Mut2, R4Mut3, R4Mut4, R4Mut5, and R4Mut6.

In an embodiment, the invention provides FGFR fusion proteins comprising variants of the ECD of wildtype FGFR polypeptides, where the variants have deletions or point mutations in the C-terminus of the ECD, for example, in the region of the MMP-2 cleavage site. These variants may be more resistant to cleavage by MMP-2 than wildtype FGFR extracellular domains. In an embodiment, the invention provides FGFR extracellular domains which are deletion mutants that have the MMP-2 cleavage site removed and which are more resistant to cleavage by MMP-2 than wild-type FGFR extracellular domains. For example, the invention provides deletion mutants of the FGFR extracellular domains in that region at the C-terminus of the IgIII domain and N-terminal to the Fc domain. Any one or more amino acids of any of the seven FGFR extracellular domains in this region may be deleted or, otherwise mutated. By way of example, the invention provides deletion mutants of FGFR1, FGFR2, FGFR3, and FGFR4 corresponding to R1Mut1, R1Mut2, R1Mut3, and R1Mut4, shown in FIG. 1A; R1Mut7, as shown in FIG. 1B; and R4Mut1, R4Mut2, R4Mut3, R4Mut4, and R4Mut5, as shown in FIG. 2. These variants, as well as their parental, unmutated polypeptides, all bind at least one FGF ligand. The ligand-binding characteristics of these mutants, as well as their parent FGFRs, can be determined by binding assays known in the art.

In an embodiment, the invention provides an FGFR fusion molecule comprising a first molecule that comprises one or more soluble extracellular domain of an FGFR and/or a biologically active fragment thereof and a second molecule, wherein the second molecule confers an extended half-life to the first molecule in an animal, wherein the second molecule is other than a naturally occurring Fc polypeptide, and wherein the fusion molecule is a variant Fc polypeptide.

When FGFR1-IIIc-Fc fusion protein was produced in host cells, injected into animals, and examined by gel electrophoresis, it was observed that FGFR IIIc-Fc was partially cleaved both in vivo and in vitro. Degraded fragments in the cell culture media and serum samples were consistent with the size of fragments predicted following cleavage of the Fc fusion partner from the fusion protein. MMP-2 added exogenously to FGFR1-IIIc-Fc in vitro reproduced the degraded fragments observed in the serum and culture medium.

Accordingly, the invention provides recombinant FGFR fusion proteins resistant to cleavage and with improved pharmacokinetic profiles compared to the naturally-occurring forms. For example, the invention provides FGFR fusion proteins that are more resistant to degradation both in vitro and in vivo. These FGFR fusion protein constructs may have single amino acid changes in the cleavage sites of serum proteases. They may also have global deletions of the cleavage sites. These constructs can be made by altering the naturally-occurring sequences using methods known to those of skill in the art. The invention also provides FGFR constructs wherein the junction between the extracellular domains and transmembrane domains of the receptor are modified to remove proteolytic degradation sites by methods known to those of skill in the art.

In addition to the deletion mutants described above, the invention provides single point mutants, such as substitution mutants resistant to MMP-2 cleavage. Natural substrates of MMP-2 have a preponderance of proline at the third residue N-terminal to the MMP-2 cleavage site, but have not been described to have either methionine or glycine residues at this site. Accordingly, the invention provides for point mutants corresponding to R1Mut8 (P364M), R1Mut9 (M367N), and R1Mut10 (P364G), such as shown in FIG. 1B, for example. P364M is expected to have a similar hydrophobicity profile and P364G is expected to have greater flexibility than wild-type. Also by way of example, the invention provides the M367N substitution mutation of the methionine of the MMP-2 cleavage site. Asparagine (N) has not been described in any natural or synthetic MMP-2 substrate, thus its substitution can be expected to attenuate or prevent cleavage by MMP-2. The M367N mutation also introduces a potential glycosylation site, namely, NTS into the FGFR1 ECD. If this glycosylation site is utilized by the host cell in vitro or in vivo, the N-linked sugars could further shield the FGFR1-IIIb or FGFR1-IIIc extracellular domain from proteolysis. The invention further provides the double variant of FGFR1-IIIb or FGFR1-IIIc, P364G/M367N. Any of the mutants of the invention may, optionally, comprise a linker sequence.

In addition to the deletion and substitution mutants of the FGFR fusion molecules described above, the invention provides insertion, inversion, and repeat mutants. Some amino acid sequences of FGFR fusion molecules can be varied without significant effect on the structure or function of the protein while others are critical for determining activity. Accordingly, the invention includes variations of the FGFR fusion proteins which show substantial FGFR polypeptide activity and/or which include regions of the FGFR extracellular domains. Mutants of the invention may have the receptor activity of wild-type FGFR or may have activities enhanced or reduced, or broadened with respect to FGF ligand binding capability, as compared to wildtype. Methods of making these mutants are generally known in the art.

Variations of the FGFR fusion proteins of the invention can be made and are included herein. Guidance concerning how to make phenotypically silent amino acid substitutions is provided by Bowie et al., *Science* 247:1306-1310 (1990). Genetic engineering techniques can be used to introduce amino acid changes at specific positions of the FGFR fusion protein and selections, or screens, can be used to identify sequences that maintain functionality.

For example, the art cited herein can be followed to produce proteins tolerant of amino acid substitutions. This art indicates which amino acid changes are likely to be permissive at a certain position of a protein. For example, most buried amino acid residues require nonpolar side chains, whereas few features of surface side chains are generally conserved. Typically conservative substitutions of the FGFR fusion proteins are tolerated, such as replacements, one for another, among the aliphatic amino acids Ala, Val, Leu, and Ile; interchange of the hydroxyl residues Ser and Thr, exchange of the acidic residues Asp and Glu, substitution between the amide residues Asn and Gln, exchange of the basic residues Lys and Arg, and replacements between the aromatic residues Phe and Tyr. Substitutions of charged amino acids with other charged or neutral amino acids may produce proteins with desirable improved characteristics, such as less aggregation. Aggregation may not only reduce activity but also be problematic when preparing pharmaceutical formulations, because, for example, aggregates can be immunogenic (Pinckard et al., *Clin. Exp. Immunol.* 2:331-340 (1967); Robbins et al., *Diabetes* 36:838-845 (1987); Cleland et al., *Crit. Rev. Therapeutic Drug Carrier Systems*, 10:307-377 (1993)). As described above, the binding of FGF ligands to FGFRs is both selective and overlapping. Selected ligands bind to a particular FGFR, but more than one ligand can bind to a receptor and an FGF ligand may bind to multiple FGFR. Mutating amino acids in the FGFR fusion proteins of the invention can change the selectivity of FGF ligand binding to FGFRs.

Transgenic, Knockout, and Other Animals

The invention provides transgenic and knockout animals, respectively expressing exogenous FGFR and lacking endogenous FGFR, as well as animals injected with the FGFR fusion proteins of the invention or the nucleic acid molecules which encode them. Transgenic animals of the invention are generally made by expressing an FGFR fusion molecule as described herein with a vector comprising an exogenous promoter and an FGFR extracellular domain and targeting the vector to a predetermined locus, wherein the expression pattern of the FGFR fusion transgene is determined by the expression pattern of the exogenous promoter. Knockout mice are generally made by selectively inactivating endogenous FGFR and replacing it with a mutant allele.

Nonhuman animals of any species, including, but not limited to, mice, rats, rabbits, hamsters, guinea pigs, pigs, micropigs, goats, sheep, cows, and non-human primates, for example, baboons, monkeys, and chimpanzees, may be used to generate transgenic and knockout animals. In a specific embodiment, techniques described herein or otherwise known in the art, are used to express FGFR fusion molecules of the invention in humans, as part of a gene therapy protocol.

Any technique known in the art may be used to introduce an FGFR transgene into animals to produce a founder lines of transgenic animals. Known techniques may also be used to "knock out" endogenous FGFR genes. Techniques for producing transgenic and knockout mice include, but are not limited to, pronuclear microinjection (Paterson et al., *Appl. Microbiol. Biotechnol.* 40:691-698 (1994); Carver et al., *Bio-technology (NY)* 11: 1263-1270 (1993); Wright et al., *Bio-technology (NY)* 9:830-834 (1991); and Hoppe et al., U.S. Pat. No. 4,873,191 (1989)); retrovirus mediated gene transfer into germ lines, blastocysts, or embryos (Van der Putten et al., *Proc. Natl. Acad. Sci.* 82:6148-6152 (1985)); gene targeting in embryonic stem cells (Thompson et al., *Cell* 56:313-321 (1989)); electroporation of cells or embryos (Lo, *Mol. Cell. Biol.* 3:1803-1814 (1983)); introduction of the polynucleotides of the invention using a gene gun (Ulmer et al., *Science* 259:1745 (1993)); introducing nucleic acid constructs into embryonic pluripotent stem cells and transferring the stem cells back into the blastocyst; and sperm-mediated gene transfer (Lavitrano et al., *Cell* 57:717-723 (1989). For a review of such techniques, see Gordon, *Intl. Rev. Cytol.* 115: 171-229 (1989); U.S. Pat. No. 5,464,764 (Capecchi et al.); U.S. Pat. No. 5,631,153 (Capecchi et al.); U.S. Pat. No. 4,736, 866 (Leder et al.); and U.S. Pat. No. 4,873,191 (Wagner et al.). Any technique known in the art may be used to produce transgenic clones containing polynucleotides of the invention, for example, nuclear transfer into enucleated oocytes of nuclei from cultured embryonic, fetal, or adult cells induced to quiescence (Campbell et al., *Nature* 380:64-66 (1996); Wilmut et al., *Nature* 385:810-813 (1997)).

Gene targeting can be used to integrate the FGFR transgene into the chromosomal site of an endogenous gene. Briefly, vectors comprising nucleotide sequences homologous to the endogenous gene are designed for the purpose of integrating, via homologous recombination with chromosomal sequences, into and disrupting the function of the nucleotide sequence of the endogenous gene. The FGFR transgene may also be selectively introduced into a particular cell type, thus inactivating the endogenous FGFR gene in only that cell type, by following, for example, the teaching of Gu et al., *Science* 265:103-106 (1994). The regulatory sequences required for such a cell-type specific inactivation will depend upon the particular cell type of interest, and will be apparent to those of skill in the art.

The expression of the recombinant FGFR transgene or knockout allele may be assayed in the animals of the invention using standard techniques. Initial screening may be accomplished by Southern blot analysis or PCR techniques to verify that integration of the transgene or null allele has taken place. The level of mRNA expression of the transgene or null allele in animal tissues may be assessed using techniques which include, but are not limited to, Northern blot analysis, in situ hybridization analysis, and reverse transcriptase-PCR (RT-PCR). Samples of FGFR transgene-expressing or FGFR null tissue may also be evaluated immunocytochemically or immunohistochemically using specific antibodies.

The invention provides transgenic animals which carry an FGFR transgene in all their cells, as well as animals which carry the transgene in some of their cells, such as mosaic or chimeric animals. The transgene may be integrated as a single transgene or as multiple copies, such as in concatamers, for example, head-to-head tandems or head-to-tail tandems. An FGFR transgene may also be selectively introduced into and activated in a particular cell type by following, for example, the teaching of Lasko et al., *Proc. Natl. Acad. Sci.* 89:6232-6236 (1992)). The regulatory sequences required for such a cell-type specific activation will depend upon the particular cell type of interest, and will be apparent to those of skill in the art.

Founder transgenic animals may be bred, inbred, outbred, or crossbred to produce colonies of a particular animal. Examples of such breeding strategies include, but are not limited to, outbreeding of founder animals with more than one integration site in order to establish separate lines; inbreeding of separate lines in order to produce compound transgenics that express the transgene at higher levels because of the effects of additive expression of each transgene; crossing heterozygous transgenic animals to produce animals homozygous for a given integration site in order to both augment expression and eliminate the need for screening of animals by DNA analysis; crossing separate homozygous lines to produce compound heterozygous or homozygous lines; and breeding to place the transgene on a distinct background appropriate to an experimental model of interest.

In an embodiment, the FGFR fusion proteins of the invention are expressed in transgenic non-human animals produced by the method described in WO 03/020743. In this method, a cassette including a transgene of interest is targeted to one or more predetermined loci, including loci expressed in most or all cell types. The cassette can function as an autonomous unit, directing the expression of the transgene and optional regulatory or accessory genes in the cassette. The transgene is expressed under the control of the exogenous promoter within the cassette. Thus, the expression pattern of the transgene is determined by the nature of the exogenous promoter.

Transgenic and knock-out animals of the invention have uses which include, but are not limited to, animal model systems useful in elaborating the biological function of FGFRs, studying conditions and/or disorders associated with aberrant expression of FGFRs, and in screening for compounds effective in modifying or ameliorating these conditions and/or disorders.

Animals comprising the nucleic acid molecules or the FGFR fusion proteins of the invention are those that have been injected with either the FGFR fusion protein or the nucleic acid construct, such as by hydrodynamic tail vein transfection method, and such as using the mini-circle vector construct previously described.

FGFR Fusion Proteins as Decoy Receptor Traps

The FGFR fusion proteins of the invention can function as decoy receptors for trapping FGF ligands and inhibiting their interaction with FGFR on cell surfaces. Decoy receptors, such as those of the invention, recognize their ligands with high affinity and specificity but are structurally incapable, of signaling. They compete with wild-type receptors for ligand binding and participate in ligand/receptor interactions, thus modulating the activity of or the number of functioning receptors and/or the cellular activity downstream from the receptors. Decoy receptors can act as molecular traps for agonist ligands and thereby inhibit ligand-induced receptor activation.

Prior to the teachings of the present invention, it was not known whether tumors or proliferative cells are dependent on FGF growth factors in vivo or which FGF ligand may be blocked in order to inhibit tumor progression or cell proliferation. Furthermore, it has not been previously reported that the ability to block FGF-induced proliferation correlates with lowered levels of FGFR activation.

The FGFR fusion proteins of the invention can be used in combination with other decoy receptor traps. Etanercept (Enbrel®) is an example of a genetically engineered decoy receptor trap comprising a fusion protein of the extracellular ligand-binding domain of the human TNF-α receptor and the Fc region of human IgG1. It acts as a decoy by competitively inhibiting TNF-α binding to naturally-occurring TNF-αreceptors on the cell-surface, thus inhibiting TNF-α induced proinflammatory activity. Etanercept acts as a cytokine "sponge" and TNF-antagonist, rendering TNF-α biologically inactive (Goldenberg et al., *Clin. Ther.* 21:75-87 (1999)). It is used to treat rheumatoid arthritis, juvenile rheumatoid arthritis, psoriatic arthritis, and ankylosing spondylitis.

The FGFR fusion proteins of the invention can also be used with a VEGF Trap, which is another example of a soluble recombinant decoy fusion protein, and is currently in clinical trials. A genetically engineered fusion protein of one or more extracellular ligand-binding domain of the human vascular endothelial growth factor (VEGF) receptor and the Fc region of human IgG1, the VEGF Trap inhibits angiogenesis by acting as a decoy for naturally-occurring cell surface VEGF receptors. By inhibiting angiogenesis, VEGF decoys can shrink tumors which rely on angiogenesis for their viability. The biological activity of the decoy trap depends on the portion of the receptor used in the trap. For example, a fusion protein of the first three Ig domains of the VEGFR1 receptor isoform and the Fc region of human IgG1 binds to VEGF with an affinity in the picomolar range and has potent anti-tumorigenic activity but a short in vivo half life and significant toxicity (Holash et al., *Proc. Natl. Acad. Sci.* 99:11,393-11, 398 (2002)). VEGF decoy fusion proteins can be engineered to prolong the in vivo pharmacokinetic and pharmacodynamic profiles, minimize toxicities, and potently inhibit growth and vascularization. Removing a highly basic ten amino acid sequence from the third VEGF1 Ig domain, removing the entire first VEGF11 g domain, and fusing the second Ig domain of VEGFR1 with the third Ig domain of VEGFR2 have been reported to improve the clinical parameters (Holash et al., *Proc. Natl. Acad. Sci.* 99:11,393-11,398 (2002)). The combination of an FGFR fusion protein and the VEGF Trap can be more potent than either alone in inhibiting angiogenesis.

The invention provides FGFR decoy receptor trap fusion proteins and demonstrates that they inhibit the binding of ligands to FGFRs, as shown in greater detail below. The decoy fusion proteins sequester the ligands, preventing ligand-receptor binding. The ability of the FGFR receptor trap fusion proteins to inhibit receptor-ligand binding can be demonstrated using assays known in the art, for example, competition ELISA assays, as described in more detail below.

The invention provides FGFR decoy receptor traps as therapeutic agents. The FGFR decoy receptor traps of the invention bind to various FGFs, described in more detail herein, which have been demonstrated to be over-expressed in proliferative disease states, compared to normal. These traps can bind FGF ligand with very high affinity, for example, they may bind FGF-2 with a Kd of approximately 15 picomolar. Furthermore, these traps can interfere with FGF signaling in abnormal tissues. The FGFR1-IIIc-Fc and FGFR4-Fc traps of the invention, for example, can dampen the signaling of FGFR1-IIIc and FGFR4, and perhaps other members of the FGFR family (Zhang et al., *J. Biol. Chem.* 281:15, 694-15,700 (2006)).

Introducing gene trap vectors into embryonic stem cells has produced transgenic animal lines that reflect the gene expression patterns of receptor domains of interest (Coffin et al., Retroviruses Cold Spring Harbor Lab. Press (1997)). Accordingly, the invention provides the use of FGFR gene trap vectors to identify discrete expression patterns of FGFR genes during signal transduction events associated with normal and disease states. Constructs with a reporter gene but lacking a promoter are designed so that activation of the reporter gene depends on its insertion within an active transcription unit. Integration results in an expression pattern that reflects the pattern of the endogenous transcription unit. The reporter gene provides a molecular tag for cloning the "trapped" gene of the transcription unit. Reporter systems which can be used with gene trap vectors are known in the art. Following insertion, the tagged gene can be detected in space and time by assaying for the reporter gene product.

Real-Time Detection of Ligand-Receptor Binding

As described herein, FGFs are over-expressed in certain disease states. By acting as decoy receptor traps, FGFR fusion proteins attenuate the biological activities of the over-expressed FGFs. The profile of FGFs which bind to a particular FGFR fusion protein in vitro can predict the therapeutic profile of that fusion protein in vivo. Accordingly, the invention provides ligand-binding profiles for FGFR fusion proteins of the invention and methods of using FGFR fusion molecules of the invention to treat diseases that over-express FGF ligands.

The invention provides direct ligand-receptor binding measurements by surface plasmon resonance (SPR) using Biacore technology (Biacore; Piscataway, N.J.), which utilizes biosensor chips to measure binding interactions in real time (Dawson et al., *Molec. Cell. Biol.* 25:7734-7742 (2005)). The technology is based on SPR optical phenomena and detects changes in refractive index that occur close to a sensor chip's surface. One of the interacting components is immobilized on a flexible dextran layer linked to the sensor chip surface, and an interacting partner flows in solution across the surface. Interaction between the two components immobilizes the interacting partner, increasing the mass at the sensor chip surface. The increased mass results in an optical signal, which is recorded in resonance units (RU). One RU represents approximately one picogram of protein bound to the surface. Biacore technology has been described in U.S. Pat. Nos. 6,999,175 B2; 6,808,938 B2; and 5,641,640.

As described in more detail below, FGF ligand binding to fusion proteins of the invention was measured using the Biacore® X system to measure surface plasmon resonance (SPR). This method provided a ranking of the relative affinities of FGF ligands for the FGFR fusion proteins of the invention, for example, FGFR1-IIIc-Fc, R1Mut4, FGFR3-IIIc-Fc, and FGFR4-Fc. Accordingly, the invention provides a method of treating a disease characterized by one or more FGFs which are expressed at a higher level than normal by administering a binding FGFR fusion protein of the invention.

Biomarkers of FGFR Fusion Molecule Treatment

Biomarkers can be used to monitor the results of treating subjects with FGFR fusion proteins, including demonstrating efficacy as an end point in clinical trials. Suitable biomarkers will indicate that an FGF-FGFR signaling pathway is affected by the FGFR fusion protein. For example, FGF-2 is a suitable biomarker for FGFR1 because a decrease in FGF-2 levels in a subject treated with an FGFR1 fusion protein would indicate that the fusion protein bound FGF-2, sequestered it from active FGFRs, and thus demonstrated treatment efficacy.

Components of the FGFR signaling pathway may also serve as biomarkers to demonstrate treatment efficacy. For example, FGFRs produce intracellular responses to extracellular ligand binding by intracellular signaling. FGF binding to the extracellular domain of the intact transmembrane receptor activates the catalytic tyrosine kinase domain present on the cytoplasmic portion of the receptor. The ligand induces the FGFR to autophosphorylate a cytoplasmic tyrosine residue, which then serves as part of a high-affinity binding site for intracellular signaling proteins. One group of these signaling proteins, the extracellular signal regulated kinases (Erks), also known as mitogen-activated protein (MAP) kinases, become activated when FGFR phosphorylates a threonine and a nearby tyrosine on the Erk protein. Reportedly, ligand binding to cell surface FGFRs initiate a signal transduction cascade that includes the phosphorylation of Erk to phospho-Erk (pErk). Erk activation therefore provides a biomarker for FGFR fusion molecule treatment by providing a measurement of FGFR intracellular signaling activity, which can be quantified by measuring the phosphorylation of the threonine and tyrosine residues. Erk activation can be determined by methods known in the art and demonstrated in more detail below. Commercial reagents are available that detect Erk immunologically from cell lysates. ELISA and/or Western blot analyses can be performed using these reagents to identify and measure phosphorylated Erk by methods well-known in the art.

Other biomarkers may also be used to monitor FGFR fusion protein treatment by providing a measurement of the FGFR signaling pathway. For example, a reduction in phosphorylated FGFR (pFGFR), or a reduction of the basal phosphorylation level of fibroblast growth factor receptor substrate 2 (pFRS2) and/or dual specificity phosphatase (DSP) would indicate efficacious treatment with FGFR fusion proteins.

FGFR Fusion Proteins Inhibit the Viability and/or Proliferation of Proliferative Cells Proliferative cells often depend on extracellular signaling by growth factors for their survival and growth. The FGFR fusion proteins of the invention can inhibit the viability and/or the proliferation of cancer cells and other proliferative cells both in vitro and in vivo. Accordingly, the invention provides methods of inhibiting viability and/or proliferation of proliferative cells, methods of inhibiting angiogenesis, and methods of treating cancer in a subject by providing an FGFR fusion protein, as described herein, and administering the fusion protein to the subject. The effect of FGFR fusion proteins on cell viability and/or proliferation in vitro was examined on cultured tumor cells and their effects on tumor cell viability and proliferation in vivo was examined in an animal tumor model.

The CellTiter-Glo™ Luminescent Cell Viability Assay (Promega; Madison, Wis.), which was designed to measure the number of viable cells in culture (Sussman et al., *Drug Disc. Dev.* 5:71-71 (2002), was used herein to determine cell viability and proliferation. Cellular adenosine triphosphate (ATP) levels indicate cell viability; ATP levels drop rapidly when the cell loses viability. The assay uses a stable form of firefly luciferase to measure ATP as an indicator of metabolically active, i.e., viable, cells. The luciferase converts beetle luciferin to luciferin oxide in the presence of ATP, magnesium, and oxygen. The resulting luminescent signal is proportional to the number of viable cells present in the culture and can be detected with a luminometer or CCD camera. Because the signal is proportional to cell number, it measures both viability and proliferation. Under stated media and serum conditions, the assay is linear over a wide range of cell numbers.

The invention provides methods of using the FGFR fusion proteins of the invention to inhibit the viability and/or proliferation of multiple proliferative cell types, whether dysplastic cells, premalignant cells or malignant tumor cells; methods to inhibit the viability and/or proliferation of other cell types, such as endothelial cells; and methods to inhibit angiogenesis, in vitro, ex vivo, or in vivo. As described in more detail below, FGFR fusion proteins of the invention can be used to inhibit a wide variety of cancer cell types, including lung, kidney, brain, breast, liver, ovarian, prostate, and/or colorectal cancer cells, for example. The FGFR fusion proteins of the invention each have different specificities to different cancer cell types, as shown in greater detail below, and can be used to treat different tumor types depending on such specificities.

For example, the FGFR fusion proteins of the invention, such as FGFR1IIIc-Fc fusion proteins, can be used to inhibit the viability and/or proliferation of malignant human glioma cells (for example, U251 cells); malignant human brain cancer cells (for example, SF268 cells); human lung cancer cells (for example, A549 cells); malignant lung non-squamous carcinoma cells (for example, NCI-H522 and NCI-H226 cells); malignant glioblastoma cells (for example, U118 and WT111 cells); and malignant kidney cells (for example, Caki-1 cells).

The invention also provides methods for using FGFR fusion proteins of the invention to inhibit the proliferation of tumor cells and other proliferative cells, such as endothelial cells, in vivo. This in vivo activity can be demonstrated by administering the FGFR fusion protein of the invention to inhibit in vivo formation of tumors in animal xenograft models. As shown herein, FGFR1-IIIc-Fc effectively inhibited tumor growth in this model. Accordingly, the invention provides a method of inhibiting tumor growth and tumor cell proliferation in a subject by providing a composition comprising an FGFR fusion protein of the invention and administering the composition to the subject.

The invention provides methods of inhibiting viability and/or proliferation of proliferative cells, such as endothelial cells, under conditions in which the proliferation of such cells is not desirable. For example, macular degeneration and tumor angiogenesis are conditions under which excess growth of blood vessels, thus endothelial cells, is undesirable. Accordingly, the invention further provides methods of inhibiting angiogenesis by administering the FGFR fusion proteins of the invention to a subject in need of such treatment. As described in greater detail below, dosing schedules and dosing routes are generally known in the art; the latter may include intravenous, subcutaneous, intraperitoneal, and oral administration.

FGF and FGFR Expression in Human Cancers

Gene amplification is among the mechanisms of oncogene activation that can lead to specific types of cancers. The invention provides an analysis of the gene expression profile of breast cancer tissues residing in the proprietary GeneLogic database, and the finding that the FGFR1 gene was amplified in 10-15% of breast cancer patients. As described herein, such gene amplification has implications for tumor cell growth and/or survival, thus interrupting signaling between an FGFR and an FGF ligand is a useful approach to inhibiting tumor growth.

The invention also provides further analysis of the expression profiles of different tumor types resident in the proprietary GeneLogic database for FGF and FGFR expression, and the finding that certain tumors expressed a higher level of FGFR1, FGFR3, and/or FGFR4. The invention further provides that certain tumors expressed a higher level of certain FGF ligands, implicating active FGF/FGFR signaling pathways in maintaining the viability and/or proliferative capacity of the cancer cells or the endothelial cells feeding the cancer cells. Information relating to the tumor types that over-express an FGFR and/or an FGF is provided in the tables below.

Accordingly, the invention provides methods and compositions for FGFR fusion proteins which are suitable for use in treating proliferative diseases characterized by over-expression of an FGFR, FGF, or both. The analysis performed herein and described in greater detail in the Examples, provides the FGFR and FGF gene expression profiles of various hyperproliferative tissues. Thus, the over-expression of the FGFRs and their ligands are correlated with particular disease states. The FGFR fusion proteins of the invention are efficacious in treating the diseases in which the FGFR component, or its ligand, is over-expressed.

Therapeutic Compositions and Formulations

Routes of Administration and Carriers

The FGFR fusion molecules of the invention can be administered in vivo by a variety of routes, including intravenous, intra-arterial, subcutaneous, parenteral, intranasal, intramuscular, intracardiac, intraventricular, intratracheal, buccal, rectal, intraperitoneal, intradermal, topical, transdermal, and intrathecal, or otherwise by implantation or inhalation. They may be administered in formulations, as described in more detail below. They may be administered in powder form intranasally or by inhalation. They may be administered as suppositories, for example, as formulated by mixing with a variety of bases, such as emulsifying bases, water-soluble bases, cocoa butter, carbowaxes, and polyethylene glycols; which melt at body temperature, yet are solidified at room temperature. Jet injection can be used for intramuscular or intradermal administration (Furth et al., *Anal. Biochem.* 205:365-368 (1992)). The DNA can be coated onto gold microparticles and delivered intradermally by a particle bombardment device, or "gene gun" as described in the literature (Tang et al., *Nature* 356:152-154 (1992)), where gold microprojectiles are coated with the DNA, then bombarded into skin cells. These methods of in vivo administration are known in the art.

In some embodiments, fusion molecule compositions are provided in formulation with pharmaceutically acceptable carriers, a wide variety of which are known in the art (Gennaro, *Remington: The Science and Practice of Pharmacy with Facts and Comparisons: Drugfacts Plus*, 20th ed. (2003); Ansel et al., *Pharmaceutical Dosage Forms and Drug Delivery Systems*, 7$^{th}$ ed., Lippencott Williams and Wilkins (2004); Kibbe et al., *Handbook of Pharmaceutical Excipients*, 3$^{rd}$ ed., Pharmaceutical Press (2000)). Pharmaceutically acceptable carriers, such as vehicles, adjuvants, carriers, or diluents, are available to the public. Moreover, pharmaceutically acceptable auxiliary substances, such as pH adjusting and buffering agents, tonicity adjusting agents, stabilizers, wetting agents and the like, are available to the public.

The fusion molecules of the invention may be employed in combination with a suitable pharmaceutical carrier to comprise a pharmaceutical composition for parenteral administration. Accordingly, the invention provides a composition comprising an FGFR fusion molecule of the invention and a pharmaceutically acceptable carrier. Such compositions comprise a therapeutically effective amount of the polypeptide, agonist, or antagonist and a pharmaceutically acceptable carrier. Such a carrier includes, but is not limited to, saline, buffered saline, dextrose, water, glycerol, ethanol, and combinations thereof. The formulation should suit the mode of administration.

In pharmaceutical dosage, the FGFR fusion molecule compositions can be administered in the form of their pharmaceutically acceptable salts, either alone or in appropriate association or combination with other pharmaceutically active compounds. The FGFR fusion molecule compositions are formulated in accordance with the mode of administration. Thus, the subject compositions can be formulated into preparations in solid, semi-solid, liquid, or gaseous forms, such as tablets, capsules, powders, granules, ointments, solutions, suppositories, enemas, injections, inhalants, and aerosols. The methods and excipients cited herein are merely exemplary and are in no way limiting.

The agents, polynucleotides, and polypeptides can be formulated into preparations for injection by dissolving, suspending, or emulsifying them in an aqueous or nonaqueous solvent, such as vegetable or other similar oils, synthetic aliphatic acid glycerides, esters of higher aliphatic acids or propylene glycol; and if desired, with conventional additives such as solubilizers, isotonic agents, suspending agents, emulsifying agents, stabilizers and preservatives. They may be formulated into preparations for administration via inhalation, for example as formulated into pressurized acceptable propellants such as dichlorodifluoromethane, propane, nitrogen, and the like. The FGFR fusion proteins of the invention can be formulated into a sustained release microcapsules, such as with biodegradable or non-biodegradable polymers, using techniques known in the art. An example of a biodegradable formulation suitable for use herein includes poly lactic acid-glycolic acid polymer. An example of a non-biodegradable formulation suitable for use herein includes a polyglycerin fatty acid ester. A method of making these formulations is described in, for example, EP 1 125 584 A1. Other formulations for parenteral delivery can also be used, as conventional in the art.

The FGFR fusion molecule compositions will be formulated and dosed in a fashion consistent with good medical practice, taking into account the clinical condition of the individual subject, the site of delivery of the fusion molecule composition, the method of administration, the scheduling of administration, and other factors known to practitioners. The effective amount of FGFR fusion molecule for purposes herein is thus determined by such considerations.

The invention also provides a pharmaceutical pack or kit comprising one or more containers filled with one or more of effective doses of the pharmaceutical FGFR fusion protein compositions of the invention. Associated with such container(s) can be a notice in the form prescribed by a governmental agency regulating the manufacture, use, or sale of pharmaceuticals or biological products. Such a notice reflects the agency's approval for manufacture, use, or sale for human administration in addition, the FGFR fusion molecules of the invention may be employed in conjunction with other therapeutic agents.

Unit dosage forms can be provided wherein each dosage unit contains a predetermined amount of the composition containing one or more agents. In an embodiment, an FGFR fusion molecule composition is supplied in single-use prefilled syringes for injection. The composition may comprise saline, sucrose, or the like; a buffer, such as phosphate, or the like; and be formulated within a stable and effective pH range. In an embodiment, an FGFR fusion molecule composition is provided as a lyophilized powder in a multiple-use vial, which can be reconstituted upon addition of an appropriate liquid, for example, sterile bacteriostatic water. In an embodiment, an FGFR fusion molecule composition comprises one or more substances that inhibit protein aggregation, including, but not limited to, sucrose or arginine. In an embodiment, a composition of the invention comprises heparin and/or a proteoglycan.

These pharmaceutical compositions are administered in an amount effective for treatment and/or prophylaxis of the specific indication. The effective amount is typically dependent on the weight of the subject being treated, his or her physical or health condition, the extensiveness of the condition to be treated, and/or the age of the subject being treated. In general, the FGFR fusion proteins of the invention are to be administered in an amount in the range of about 5 ug/kg body weight to about 10 mg/kg body weight per dose. Optionally, the FGFR fusion proteins of the invention can be administered in an amount in the range of about 10 ug/kg body weight to about 9 mg/kg body weight per dose. Further optionally, the FGFR fusion proteins of the invention can be administered in an amount in the range of about 100 ug/kg body weight to about 8 mg/kg body weight per dose. Still optionally, the FGFR fusion proteins of the invention can be administered in an amount in the range of about 1 mg/kg body weight to about 7 mg/kg body weight per dose.

The FGFR fusion protein compositions can be administered as needed to subjects in need of inhibition of FGF ligand/FGFR signaling pathway. Determination of the frequency of administration can be made by persons skilled in the art, such as an attending physician based on considerations of the condition being treated, age of the subject being treated, severity of the condition being treated, general state of health of the subject being treated and the like. In one embodiment, an effective dose of the FGFR fusion protein is administered to a subject one or more times. In one embodiment, the FGFR fusion protein of the invention is administered to the subject at least twice a week for at least a week. In another embodiment, the FGFR fusion protein is administered at least three times a week for at least one week. In a further embodiment, the FGFR fusion protein is administered to the subject for at least two weeks. In yet another embodiment, the FGFR fusion protein of the invention is administered to the subject for at least three weeks. Administration of the FGFR fusion protein can be continuously for at least two or three weeks or can be non-continuous, such as taking a one or two week break from treatment and resuming treatment after such break.

Combination Therapy

FGFR fusion molecules of the invention may be administered alone or with other modes of treatment. They may be provided before, substantially contemporaneous with, or after other modes of treatment, for example, surgery, chemotherapy, radiation therapy, or the administration of a biologic, such as a therapeutic antibody. Accordingly, the invention provides a method of combining treatment which blocks the signaling pathways utilized by fibroblast growth factors and receptors with treatment which blocks the signaling pathways utilized by other growth factors, which can be expected to be more effective in patients with tumors that express FGFs and/or FGFRs, as well as other growth factors and/or their receptors. This therapeutic approach can be applied to rapidly growing tumors and highly vascularized tumors, for example, glioblastomas. FGFR fusion molecules of the invention can be used in combination with fusion molecules of other growth factor receptors. For example, the FGFR fusion protein of the invention can be combined with a soluble VEGFR to inhibit tumor growth and/or to inhibit angiogenesis in tumors.

Further, the invention provides combination therapy that blocks the FGF and other signaling pathways such as PDGF, VEGF, and/or EGF signaling pathways. The FGFR fusion molecules of the invention can be used in such combination therapy. One or more of the agents that inhibit PDGFR-alpha, PDGFR-beta, VEGFR, and/or EGF receptors can be combined with FGFR fusion proteins of the invention for therapeutic use. The compositions that block the FGF signaling pathways may be provided simultaneously or may be provided sequentially in any order with compositions that block the PDGF, VEGF, and/or EGF signaling pathways. Combination therapy may include the use of fusion proteins comprising the extracellular domains of PDGFR-alpha, PDGFR-beta, VEGFR, EGFR, and the FGFR fusion proteins of the invention.

Uses of FGFR Fusion Molecules

FGFR fusion molecules of the invention, and fragments and variants thereof, may be used to diagnose, provide a prognosis for, prevent, treat, and develop treatments for disorders mediated, either directly or indirectly, by hyperactive or excess FGF ligand or FGFR. FGFR fusion molecules of the invention, and fragments and variants thereof, may be administered to a patient at risk for or suffering from such a disorder.

Accordingly, the invention provides a method of diagnosing a disease characterized by the over-expression of one or more FGF and/or FGFR, or a fragment or variant thereof, by measuring the real-time receptor ligand binding of one or more FGF to one or more FGFR. The method can be performed, for example, by providing a biological specimen from a subject, and measuring the binding of an FGF ligand or FGFR in the specimen to one or more cognate FGFR or FGF ligands. The results of the binding measurements can be used to diagnose the presence or absence of a disease characterized by the over-expression of the FGF(s) or FGFR(s).

The invention also provides a method of treating a condition in a subject comprising providing a composition comprising an FGFR fusion molecule of the invention and administering the composition to the subject, wherein the condition comprises a proliferative disease, including cancers and disorders of angiogenesis. The FGFR fusion molecules of the invention are useful for inhibiting cancer cell proliferation and/or viability. The FGFR fusion molecules of the invention can be used accordingly in a variety of settings for the treatment of animal, including human, cancers.

The FGFR fusion molecules of the invention can be used to treat, modulate, or prevent malignant, pre-malignant, and benign tumors. For example, they can treat metastasizing or non-metastasizing malignant tumors, which are typically at an advanced stage of tumor development, and may be life threatening. They can also be used to treat pre-malignant tumors, which are typically at a more advanced stage of tumor development than benign tumors, but have not progressed to malignancy. They can further be used to treat benign tumors, which typically show some abnormal cell characteristics and are at an early stage in tumor development. The benign tumor may or may not progress to a pre-malignant or malignant tumor. The FGFR fusion molecules of the invention can be used to treat solid tumors formed by a collection of cells typically localized in a tissue or organ, for example, sarcomas and carcinomas such as, but not limited to fibrosarcomas, myxosarcomas, liposarcomas, chondrosarcomas, osteogenic sarcomas, chordomas, angiosarcomas, endotheliosarcomas, lymphangiosarcomas, lymphangioendotheliosarcomas, synoviomas, mesotheliomas, Ewing's tumors, leiomyosarcomas, rhabdomyosarcomas, colon carcinomas, colorectal cancers, gastic cancers, pancreatic cancers, breast cancers, ovarian cancers, prostate cancers, squamous cell carcinomas, basal cell carcinomas, adenocarcinomas, sweat gland carcinomas, sebaceous gland carcinomas, papillary carcinomas, papillary adenocarcinomas, cystadenocarcinomas, medullary carcinomas, bronchogenic carcinomas, renal cell carcinomas, hepatomas, liver metastases, bile duct carcinomas, choriocarcinomas, seminomas, embryonal carcinomas, thyroid carcinomas such as anaplastic thyroid cancers, Wilms' tumors, cervical cancers, testicular tumors, lung carcinomas such as small cell lung carcinomas and non-small cell lung carcinomas, bladder carcinomas, epithelial carcinomas, gliomas, astrocytomas, medulloblastomas, craniopharyngiomas, ependymomas, pinealomas, hemangioblastomas, acoustic neuromas, oligodendrogliomas, meningiomas, melanomas, neuroblastomas, and retinoblastomas. Also among the cancers within the scope of the invention are hematologic malignancies, breast cancer, such as infiltrating ductal carcinoma and adenocarcinoma; lung cancer, such as squamous cell carcinoma, non-small cell lung cancer, and lung adenocarcinoma; prostate cancer; bladder cancer; pancreatic cancer; ovarian cancer, salivary cancer; pituitary cancer; renal cell carcinoma; melanoma; glioblastoma; retinoblastoma; and/or cancer metastases in bone, including bone metastasis from prostate cancer.

Tumors comprising dysproliferative changes, such as hyperplasias, metaplasias, and dysplasias, can be treated, modulated, or prevented with the present invention as well, such as those found in epithelial tissues, including the cervix, esophagus, and lung, for example. Hyperplasia is a form of controlled cell proliferation involving an increase in cell number in a tissue or organ, without significant alteration in structure or function. By way of example, endometrial hyperplasia often precedes endometrial cancer. Metaplasia is a form of controlled cell growth in which one type of adult or fully differentiated cell substitutes for another type of adult cell. Metaplasia can occur in epithelial or connective tissue cells. Atypical metaplasia involves a somewhat disorderly metaplastic epithelium. Dysplasia is frequently a forerunner of cancer, and is found mainly in the epithelia; it is a disorderly form of non-neoplastic cell growth, involving losses in individual cell uniformity and in the cell's architectural orientation. Dysplasia characteristically occurs where there exists chronic irritation or inflammation and is often found in the cervix, respiratory passages, oral cavity, and gall bladder. Other examples of benign tumors which can be treated, modulated or prevented in accordance with the present invention include arteriovenous (AV) malformations, particularly in intracranial sites and myoleomas.

The FGFR fusion molecules of the invention, or variants or fragments thereof, can be used to treat cancer patients sensitive to the effects of FGFR signaling. They are useful in a subset of patients that over-express FGFR1 and/or FGF-2, for example, subsets of patients with breast cancer, lung cancer, kidney cancer, prostate cancer, and glioblastoma. Treatment effectiveness can be assessed, for example, by measuring the patient's level of a biomarker, for example, FGF-2, pFGFR, DSP, and/or pFRS2 (Guddo et al., *Hum. Pathol.* 30:788-794 (1999)), as described above.

The invention also provides compositions and methods for treating glioblastoma, a rapidly growing and highly vascularized tumor. Platelet-derived growth factor (PDGF) is expressed at high levels in many human glioblastomas. Further, in addition to their role in promoting tumor cell growth and survival, FGFs are potent angiogenic factors which may be expected to promote the growth of highly vascular tumors, such as glioblastomas. Blocking the effects of PDGF on cell growth or survival together with blocking the FGF signaling pathway with the FGFR fusion protein of the invention may thus retard the progression of glioblastoma development.

FGF-2 and FGFR1 are expressed in the tumor cells and the tumor-associated stromal cells and vessels of patients with non-small cell lung cancer. The FGFR fusion proteins of the invention, such as FGFR1-IIIc-Fc or R1Mut4, for example, can be administered to such patients to block growth stimulation by FGF-2 binding to FGFR1 and inhibit tumor growth.

Stromal-epithelial interactions are important determinants of malignant vs. benign prostatic growth (Conte et al., *Int. J. Cancer* 107:1-10 (2003)). Prostate cancer, and also breast cancer, kidney cancer, and multiple myeloma, tend to metastasize to the bone. While breast cancer bone metastases tend to form lytic bone lesions, prostate cancer metastases tend to form blastic lesions characterized by an excess of abnormally dense bone. Further interaction of prostate cancer metastases with the local bone environment may then alter normal bone homeostasis, shifting it toward an osteoblastic phenotype. Kidney metastases may exhibit both lytic and blastic bone lesions.

Since FGFs contribute to normal bone formation and are expressed locally in the bone stromal environment, they may play a role in seeding, growth, and survival of prostate cancer bone metastases. FGFs have been implicated in bone formation, affecting osteoprogenitor cell replication, osteoblast differentiation, and apoptosis. Thus, agents which block FGF/FGFR interactions, including FGFR fusion molecules of the invention, or variants or fragments thereof, can be used to treat bone metastases in prostate cancer. Such agents will not only inhibit local osteoblastic conversion events, but also inhibit initial seeding, growth, and survival of prostate cancer bone metastases.

The invention also provides methods of using FGFR fusion proteins of the invention, or variants or fragments thereof, to inhibit angiogenesis, for example, in tumorigenesis and macular degeneration. By way of example, fusion proteins comprising FGFR1-IIIc and/or FGFR4 may be used to bind undesirable proangiogenic FGFs and decrease angiogenesis. Useful compositions include those comprising fusion molecules comprising the fusion proteins of the invention as described herein, including those with Fc fusion partners.

The invention provides methods of treating cancers resistant to other cancer therapeutic agents. For example, the FGFR fusion proteins of the invention can be used to treat cancers resistant to ErbB oncogene inhibitors, such as Herceptin®. They are also useful in treating cancers resistant to inhibitors of VEGF, such as Avastin®.

The FGFR fusion proteins and the polynucleotide molecules that encode them are useful in treating proliferative diseases and diseases involving angiogenesis, including cancer. They can be used to diagnose, prevent, and treat these diseases.

With respect to ranges of values, the invention encompasses each intervening value between the upper and lower limits of the range to at least a tenth of the lower limit's unit, unless the context clearly indicates otherwise. Further, the invention encompasses any other stated intervening values. Moreover, the invention also encompasses ranges including either or both of the upper and lower limits of the range, unless specifically excluded from the stated range.

Unless defined otherwise, the meanings of all technical and scientific terms used herein are those commonly understood by one of skill in the art to which this invention belongs. One of skill in the art will also appreciate that any methods and materials similar or equivalent to those described herein can also be used to practice or test the invention.

It must be noted that, as used herein and in the appended claims, the singular forms "a," "or," and "the" include plural referents unless the context clearly dictates otherwise. Thus, for example, reference to "a subject polypeptide" includes a plurality of such polypeptides and reference to "the agent" includes reference to one or more agents and equivalents thereof known to those skilled in the art, and so forth.

Further, all numbers expressing quantities of ingredients, reaction conditions, % purity, polypeptide and polynucleotide lengths, and so forth, used in the specification and claims, are modified by the term "about," unless otherwise indicated. Accordingly, the numerical parameters set forth in the specification and claims are approximations that may vary depending upon the desired properties of the present invention. At the very least, and not as an attempt to limit the application of the doctrine of equivalents to the scope of the claims, each numerical parameter should at least be construed in light of the number of reported significant digits, applying ordinary rounding techniques. Nonetheless, the numerical values set forth in the specific examples are reported as precisely as possible. Any numerical value, however, inherently contains certain errors from the standard deviation of its experimental measurement.

The specification is most thoroughly understood in light of the references cited herein. Each of these references is hereby incorporated by the reference in its entirety.

Exemplary Modes for Carrying out the Invention

The examples, which are intended to be purely exemplary of the invention and should therefore not be considered to limit the invention in any way, also describe and detail aspects and embodiments of the invention discussed above. The examples are not intended to represent that the experiments below are all or the only experiments performed. Efforts have been made to ensure accuracy with respect to numbers used (for example, amounts, temperature, etc.) but some experimental errors and deviations should be accounted for. Unless indicated otherwise, parts are parts by weight, molecular weight is weight average molecular weight, temperature is in degrees Centigrade, and pressure is at or near atmospheric.

EXAMPLE 1

Sequence Alignment of Partial IgIII Domains and the Membrane Proximal Regions of FGFRs and FGFR Variants FIG. 1A shows an alignment of the amino acid sequences of a part of the IgIII domain of each of the seven FGFR family members, FGFR1-IIIb, FGFR1-IIIc, FGFR2-IIIb, FGFR2-IIIc, FGFR3-IIIb, FGFR3-IIIc, and FGFR4, using the Clustal W version 1.8 program of the European Molecular Biology Laboratory (EMBL) bioinformatics search site.

FIG. 1A also illustrates the organization of the parental FGFR1-IIIc-Fc fusion protein (nucleotide SEQ ID NO: 4, protein SEQ ID NO: 95) and corresponding mutants. The IgIII domain is followed by the C-terminal portion of the ECD, which is followed by the Fc portion of an antibody. The alignment marks the truncation locations of the R1Mut1 (nucleotide SEQ ID NO: 6, protein SEQ ID NO: 97), R1Mut2 (nucleotide SEQ ID NO: 7, protein SEQ ID NO: 98), R1Mut3 (nucleotide SEQ ID NO: 8, protein SEQ ID NO: 99), R1Mut4 (nucleotide SEQ ID NO: 9, protein SEQ ID NO: 100), and R1Mut5 (nucleotide SEQ ID NO: 10, protein SEQ ID NO: 101) variants of FGFR1-IIIc and the position of an Fc portion of an IgG antibody. R1Mut1, R1Mut2, R1Mut3, R1Mut4, and R1Mut5 also had the linker encoding amino acids "GS" removed from between the FGFR1-IIIc and Fc domains.

FIG. 1B illustrates additional variants from the parental FGFR1-IIIc-Fc, which were also made and used in the invention. The variants shown in FIG. 1B all had the linker GS removed. The variant R1Mut6 (nucleotide SEQ ID NO: 5, protein SEQ ID NO: 96), had only the GS linker deleted. Another variant, R1Mut7 (nucleotide SEQ ID NO: 11, protein SEQ ID NO: 102), had a deletion of amino acid residues PA. The variant R1Mut8 (nucleotide SEQ ID NO: 12, protein SEQ ID NO: 103), had an amino acid substitution P364M, in which the proline residue was substituted with methionine. The variant R1Mut9 (nucleotide SEQ ID NO: 13, protein SEQ ID NO: 104) had an amino acid substitution M367N, in which the methionine residue was substituted with asparagine. The variant R1Mut10 (nucleotide SEQ ID NO: 44, protein SEQ ID NO: 135) had an amino acid substitution P364G, in which the proline residue was substituted with glycine.

FIG. 2 shows an alignment of the amino acid sequences of a part of the IgIII domain of each of the seven FGFR family members, using the Clustal W version 1.8 program of EMBL (European Molecular Biology Laboratory) bioinformatics search site. FIG. 2 illustrates the organization of the FGFR4-Fc fusion protein (nucleotide SEQ ID NO: 65, protein SEQ ID NO: 156) and corresponding mutants. The alignment marks the truncation locations of the R4Mut1 (nucleotide SEQ ID NO: 71, protein SEQ ID NO: 162), R4Mut2 (nucleotide SEQ ID NO: 72, protein SEQ ID NO: 163), R4Mut3 (nucleotide SEQ ID NO: 73, protein SEQ ID NO: 164), R4Mut4 (nucleotide SEQ ID NO: 74, protein SEQ ID NO: 165), R4Mut5 (nucleotide SEQ ID NO: 75, protein SEQ ID NO: 166) and R4Mut6 (nucleotide SEQ ID NO: 66, protein SEQ ID NO: 157) variants of FGFR4. FIG. 2 also indicates the position of an Fc portion of an IgG antibody. R4Mut1, R4Mut2, R4Mut3, R4Mut4, R4Mut5, and R4Mut6 also had the linker encoding amino acids 'GS' removed from between the FGFR4 and Fc domains.

EXAMPLE 2

Expression of FGFR Fusion Proteins

The fusion proteins of the invention were expressed in 293-6E host cells using the pTT5 vector (Biotechnology Research Institute; Montreal, Canada) transfected into 293-6E cells (Biotechnology Research Institute; Montreal, Canada), which were then cultured to produce the fusion proteins. An expression vector that comprised the cDNA of FGFR1-IIIc-Fc (SEQ ID NO: 4), encoding the extracellular domain of human FGFR1-IIIc (SEQ ID NO: 1) was constructed from an open-reading frame cDNA library prepared internally. This cDNA was linked at its C-terminus through a linker encoding the amino acids GS to cDNA encoding an Fc fragment of human IgG1 heavy chain (SEQ ID NO: 80) to produce a fusion construct hereafter referenced as "FGFR1-IIIc-Fc cDNA" and the expression product thereof as "FGFR1-IIIc-Fc protein." The Fc fragment was also obtained from an open-reading frame cDNA library prepared internally. This cDNA fusion construct was inserted into a pTT5 vector by conventional techniques to produce the FGFR1-IIIc-Fc/pTT5 expression vector.

Expression constructs for expressing the FGFR3-IIIc-Fc (nucleotide SEQ ID NO: 85, protein SEQ ID NO: 176) and FGFR4-Fc fusion proteins in 293-6E host cells using the pTT5 vector were made in a manner similar to that described above using cDNAs prepared internally and conventional techniques. Similar expression constructs for expressing FGFR variants, such as R1Mut1, R1Mut2, R1Mut3, R1Mut4, R1Mut5, R1Mut6 (GS deletion), R1Mut7 (PA deletion), R1Mut8 (P364M), R1Mut9 (M367N), R4Mut1, R4Mut2, R4Mut3, R4Mut4, R4Mut5, and R4Mut6 (GS deletion) using the pTT5 vector were each made from the FGFR1-IIIc-Fc cDNA using PCR and conventional mutagenesis techniques.

The variants R1Mut1, R1Mut2, R1Mut3, R1Mut4, and R1Mut5, produced in this manner, each contained the same amino acid sequence as the parent FGFR1-IIIc-Fc fusion protein (protein SEQ ID NO: 95) except for the deletion of the linker amino acids GS and also certain amino acid residues at the C-terminus of the wildtype FGFR1-IIIc extracellular domain, as described in Example 1. R1Mut1 comprised an amino acid sequence ending with amino acid residues MTSP immediately preceding the Fc fragment. R1Mut2 comprised an amino acid sequence ending with amino acid residues RPAV immediately preceding the Fc fragment. R1Mut3 comprised an amino acid sequence ending with amino acid residues ERPA immediately preceding the Fc fragment. R1Mut4 comprised an amino acid sequence ending with amino acid residues LEAL immediately preceding the Fc fragment. R1Mut5 comprised an amino acid sequence ending with amino acid residues AWLT immediately preceding the Fc fragment. The variants R1Mut6, R1Mut7, R1Mut8, and R1Mut9, also produced in this manner, each contained the same amino acid sequence as the parent FGFR1-IIIc-Fc the linker GS removed.

The variants R4Mut1, R4Mut2, R4Mut3, R4Mut4, R4Mut5, and R4Mut6, which were described in Example 1, were also produced from 293-6E host cells using the pTT5 vector in the manner described for FGFR1-IIIc-Fc and the R1 mutants. R4Mut1 comprised an amino acid sequence ending with amino acid residues AAPE immediately preceding the Fc fragment. R4Mut2 comprised an amino acid sequence ending with amino acid residues PTWT immediately preceding the Fc fragment. R4Mut3 comprised an amino acid sequence ending with amino acid residues LPEE immediately preceding the Fc fragment. R4Mut4 comprised an amino acid sequence ending with amino acid residues TVLP immediately preceding the Fc fragment. R4Mut5 comprised an amino acid sequence ending with amino acid residues LTVL immediately preceding the Fc fragment. R4Mut6 comprised an amino acid sequence ending with amino acid residues RYTD immediately preceding the Fc fragment.

The host cell line CHO-S can, in certain embodiments, produce recombinant proteins with higher yields and/or different glycosylation patterns than the 293-6E host cell line. Fusion proteins of the invention were expressed in CHO-S host cells with the vector pcDNA3.1 (Invitrogen; Carlsbad, Calif.). The expression vectors were transfected into the CHO-S host cells (Invitrogen; Carlsbad, Calif.), which were then cultured to produce the fusion proteins. The FGFR1-IIIc-Fc cDNA was subcloned into the pcDNA3.1 vector using PCR and conventional subcloning techniques. Expression constructs for expressing FGFR3-IIIc-Fc and FGFR4-Fc fusion proteins in CHO-S host cells using the pcDNA3.1 vector were made in a manner similar to that described above, using PCR and conventional subcloning techniques.

Similar expression constructs for expressing the FGFR4-Fc variants R4Mut1, R4Mut2, R4Mut3, R4Mut4, R4Mut5, and R4Mut6 in CHO-S host cells using the pcDNA3.1 vector was made from the FGFR4-Fc cDNA using PCR and conventional subcloning techniques. Expression vectors for other FGFR-Fc fusion proteins and variants can also be made in a similar manner and the fusion proteins expressed as discussed herein using methods known in the art.

DG44 is a cell line derivative of the CHO-S cell line and can, in some embodiments, produce higher yields of recombinant proteins than CHO-S cells. The fusion proteins of the invention were expressed in DG44 host cells (Invitrogen; Carlsbad, Calif.) using the pDEF38 vector (ICOS Corporation; Bothell, Wash.) transfected into DG44 cells as host cells, which were then cultured to produce the fusion proteins. For example, FGFR1-IIIc-Fc cDNA was subcloned into the pDEF38 vector using PCR and conventional subcloning techniques.

A similar expression construct for expressing the FGFR1-IIIc-Fc variant R1Mut4 in DG44 host cells using the pDEF38 vector was made using PCR and conventional subcloning techniques. Expression vectors for other FGFR-Fc fusion proteins and variants, for example, FGFR3-IIIc-Fc and FGFR4-Fc, can also be made in a similar manner and fusion proteins expressed as discussed herein.

Long-term expression of fusion proteins in mice using a mini-circle vector with the fusion constructs, was performed as described in Chen et al., *Hum. Gene Ther.* 16:126-131 (2005); Rui, E. et al., *Hum. Gene Ther.* 16:558-570 (2005); and WO 04/020605, using a parent vector obtained from Dr. Mark Kay at Stanford University (Stanford, Calif.). This parent vector contained an alpha1-antitrypsin promoter, an apoE enhancer, a human factor IX intron, and a bovine polyA sequence. The parent vector was modified by inserting the FGFR1-IIIc-Fc, FGFR4-Fc, or R1Mut4 cDNA as the gene of interest, placing such cDNA immediately after the human Factor IX intron in the parent vector using PCR and conventional subcloning techniques. Similar expression vectors for other FGFR-Fc fusion proteins, including FGFR3-IIIc-Fc and the variants described herein, can also be made, and fusion proteins expressed, as discussed herein using methods known in the art.

EXAMPLE 3

Transient Expression of Fusion Proteins in 293-6E Cells and CHO-S Host Cells

The FGFR1-IIIc-Fc/pTT5 expression vector was designed to provide transient expression in 293-6E host cells. The 293-6E cells were previously adapted to serum-free suspension culture in Free-Style medium (Invitrogen; Carlsbad, Calif.). The cells were transfected with the expression vector while in logarithmic growth phase (log phase growth) at a cell density of between $9 \times 10^5$/ml and $1.2 \times 10^6$/ml.

In order to transfect 500 ml of cell suspension, a transfection mixture was first made by mixing 500 micrograms (ug) of the expression vector DNA in 25 milliliters (ml) of sterile phosphate buffered saline (PBS) with 1 milligram (mg) of polyethylenimine (at a concentration of about 1 mg/ml solution in sterile water) in 25 ml of sterile PBS. This transfection mixture was incubated for 15 min at room temperature. Following incubation, the transfection mixture was added to the 293-6E cells in log phase growth to transfect the cells. The cells and the transfection mixture were then incubated at 37° C. in 5% $CO_2$. After 24 hr of incubation, Trypton-N1 (Organotechnie S. A.; La Courneuve, France; 20% solution in sterile FreeStyle medium) was added to a final concentration of 0.5% (v/v). The mixture was maintained at 37° C. and 5% $CO_2$ for about 6-8 days until the cells reached a density of about $3-4 \times 10^6$ cells/ml and demonstrated greater than about 80% viability. To harvest the fusion protein from the cell culture medium, cells were pelleted at 400×g for 15 min at 4°

C. and the supernatant decanted then cleared of cell debris by centrifugation at 3,315×g for 15 min at 4° C. The cleared supernatant containing the fusion protein was then purified, as described in more detail below.

The FGFR fusion proteins FGFR3-IIIc-Fc, FGFR4-Fc, and the FGFR fusion variants R1Mut1, R1Mut2, R1Mut3, R1Mut4, R1Mut5, R1Mut6, R1Mut7, R1Mut8, and R1Mut9 were similarly produced by transient expression in 293-6E cells in pTT5 vectors constructed as described in Example 2. Other FGFR-Fc fusion proteins and variants can also be similarly made and expressed in 293-6E host cells using the methods discussed herein.

Small batches (approximately 1-2 mg) of R1Mut4 protein, for example, for use in in vivo studies, were rapidly produced from CHO-S cells grown in suspension and transiently transfected with the plasmid construct R1Mut4/pcDNA3.1. Briefly, suspension CHO-S cells (Invitrogen; Carlsbad, Calif.) were cultured in CD-CHO serum free medium supplemented with L-glutamine, and 1× hypoxanthine/thymidine (HT) (Invitrogen; Carlsbad, Calif.). The day before transfection, CHO-S cells were seeded into a shaker flask at a density of about $5\times10^5$/ml and reached a density of about $1\times10^6$/ml on the day of transfection. The cells were harvested and about $1\times10^7$ cells per transfection reaction were pelleted by centrifugation. Each cell pellet was resuspended in 0.1 ml Nucleofector V solution and transferred to an Amaxa Nucleofector cuvette (Amaxa; Cologne, Germany). About 5 ug of the R1Mut4/pcDNA3.1 plasmid DNA was added and mixed with the suspended CHO-S cells in the cuvette. Cells were then electroporated with an Amaxa Nucleofector using program U-024.

Larger batches can be produced, as well. For example, to produce 200 ml, 12 transfection reactions were carried out and the electroporated cells were cultured in CD-CHO medium (supplemented with L-glutamine, 1× hypoxanthine/ thymidine (HT) at density of $0.5\times10^6$/ml. After six days, the cell density reached about $6-7\times10^6$/ml with a viability of about 95%. The supernatant from the culture was harvested by centrifugation and was suitable for purification. Using this method, one mg of R1Mut4 protein can be produced in about one week from 200 ml of transiently transfected cultured cells.

The FGFR fusion proteins FGFR1-IIIc-Fc, FGFR3-IIIc-Fc, and FGFR4-Fc, and the variants R4Mut1, R4Mut2, R4Mut3, R4Mut4, R4Mut5, and R4Mut6 were similarly produced by transient expression in CHO-S cells in pcDNA3.1 vectors constructed as described in Example 2. Other FGFR-Fc fusion proteins and variants can also be made and expressed in CHO-S host cells using the methods discussed herein.

EXAMPLE 4

Cell Line Development for Stable Production of Fusion Proteins in CHO-S Host Cells The FGFR1-IIIc-Fc/pcDNA3.1 expression vector was designed to provide stable expression in appropriate mammalian cells, such as CHO-S. This vector was transfected into CHO-S cells containing the dihydrofolate reductase (DHFR) gene, which were derived from adherent CHO-K1 cells by adaptation to serum-free suspension culture in CD-CHO medium (Invitrogen; Carlsbad, Calif.).

Transfection was carried out using an Amaxa Nucleofector II (Amaxa; Cologne, Germany) according to manufacturer's recommendations. In this process, about $1\times10^6$ CHO-S cells were resuspended in 300 ul of Amaxa's Solution V (Amaxa; Cologne, Germany) and transferred into an electroporation cuvette. About 5 ug of plasmid DNA containing the FGFR1-IIIc-Fc/pcDNA3.1 expression vector was added to the cells in the cuvette and DNA transfer was initiated using Amaxa program U-024 in Amaxa's Nucleofector Device II. After the DNA transfer to the CHO-S cells, the cell suspension was immediately transferred into 1 ml of pre-warmed CD-CHO medium and then incubated at 37° C. for 10 min. The cell suspension was then transferred into 10 ml of pre-warmed CD-CHO medium and cultured for 48 hr in a T-75 flask at 37° C. and 5% $CO_2$. The vector pcDNA3.1 carried the G418-selection gene (Invitrogen; Carlsbad, Calif.). About 48 hr after the DNA transfer with FGFR1-IIIc-Fc/pcDNA3.1, G418 (Invitrogen; Carlsbad, Calif.) selection reagent was added to a final concentration of 400 ug/ml. About 2-3 weeks after introducing selective pressure, and when the cells reached confluency, they were expanded into T-225 flasks with fresh selection medium. The cells were then cryo-preserved until use.

The cryo-preservation medium contained 46.25% CD-CHO medium, 46.25% conditioned CD-CHO medium (usually supernatant from the culture being cryo-preserved) and 7.5% dimethyl sulfoxide (DMSO). About $5-10\times10^6$ cells/ vial were resuspended in 1 ml of cryo-preservation medium and slowly frozen (about 1° C./min) to about $-80°$ C. The following day, the frozen cells were transferred into liquid $N_2$ (about $-190°$ C.). Upon use, the cells were thawed quickly, by transferring the cryo-vial into a 37° C. water bath and resuspending the thawed cell suspension in at least 10 ml of fresh CD-CHO medium. Usually about 60% of the cells would recover and start proliferating about 24-48 hr after thawing.

Following cryo-preservation and recovery, the cells were plated on 96-well plates at a density of 2 cells/well/200 ul and cultured in CD-CHO medium at 37° C. and 5% $CO_2$ for three weeks. G418 selective pressure (400 ug/ml) was added after cell proliferation resumed. In order to identify transfected cell clones expressing FGFR1-IIIc-Fc fusion protein, the cell culture supernatant of each well was screened by Western blot. FGFR1-IIIc-Fc was detected using a polyclonal goat anti-human IgG Fc gamma-specific antibody (Jackson Immuno Research; West Grove, Pa.) conjugated to horseradish peroxidase (HRP).

FGFR1-IIIc-Fc produced from transfected CHO-S cells had a higher molecular weight than that produced from transfected 293-6E cells, indicating increased glycosylation in the CHO-S cell product. Thirty-one cell clones from wells which produced a distinct Fc-immunoreactive band in Western blot were transferred to T-75 flasks with 10 ml of CD-CHO medium with 400 ug/ml G418. After two weeks, supernatants from each of these cultures was tested by SDS-PAGE and only those transfected cell clones producing a strongly visible band were continued for further analysis. The 14 highest expressing clones were tested for cell specific productivity and ranked accordingly. The two highest producing clones were adapted to suspension culture over a period of one month. A total of ten different culture media were tested regarding volumetric protein productivity and protein integrity.

Stable CHO-S host cell lines producing FGFR4-Fc fusion protein from the pcDNA3.1 expression vector were also created in a manner similar to that described above for FGFR1-IIIc-Fc. Stable CHO-S host cell lines producing other FGFR-Fc fusion proteins and variants can also be created in a manner similar to that described herein, using the pcDNA3.1 expression vector described in Example 2.

EXAMPLE 5

Cell Line Development for Stable Production of Fusion Proteins in DG44 Cells The expression vector comprising R1Mut4/pDEF38 described in Example 2 was used to transfect DG44 cells for the stable production of R1Mut4 fusion protein. In this process, the untransfected DHFR-negative CHO cell line, DG44, was cultured in CHO-CD serum free medium (Irvine Scientific; Irvine, Calif.) supplemented with 8 mM L-glutamine, 1× hypoxanthine/thymidine (HT; Invitrogen; Carlsbad, Calif.), and 18 ml/L of Pluronic-68 (Invitrogen; Carlsbad, Calif.). About 50 ug of plasmid DNA containing R1Mut4/pDEF38 was first linearized by digestion with the restriction enzyme PvuI, then precipitated by addition of ethanol, briefly air-dried, and subsequently resuspended in 400 ul of sterile, distilled water. Cultured DG44 cells, as host cells, were seeded into a shaker flask at a cell density of about $4 \times 10^5$/ml the day before transfection, and reached a density of about $0.8 \times 10^6$/ml on the day of transfection. The cells were harvested and about $1 \times 10^7$ cells per transfection unit were pelleted by centrifugation The cells were transfected by resuspending each cell pellet in 0.1 ml of Nucleofector V solution and transferred the suspension to an Amaxa Nucleofector cuvette (Amaxa; Cologne, Germany). About 5 ug of the resuspended linearized plasmid DNA was added and mixed with the suspended DG44 cells in the cuvette. Cells were then electroporated with an Amaxa Nucleofector Device II using program U-024. Electroporated cells were cultured in CHO-CD medium for two days and then transferred into a selective medium comprising CHO-CD serum free medium supplemented with 8 mM L-glutamine, 18 ml/L Pluronic-68, and 10% dialyzed fetal calf serum (PCS; Invitrogen; Carlsbad, Calif.; without HT). This selective medium was changed once every week. After about 12 days, 1 ug/ml R3Long IGF I growth factor (Sigma; St. Louis, Mo.) was added to the medium and the culture was continued for another four days until confluent. The supernatants from pools of stably transfected cell lines were assayed by a sandwich FGFR1-IIIc-Fc ELISA to determine the product titer (for details of this sandwich ELISA, see Example 15). This transfection method generated an expression level of about 21 ug/ml for R1Mut4 from the pools of stably transfected cells.

Stable DG44 host cell lines producing FGFR1-IIIc-Fc fusion protein from the pDEF38 expression vector were also created in a manner similar to that described herein for R1Mut4. Stable DG44 host cell lines producing other FGFR-Fc fusion proteins and variants can also be created in a similar manner described herein, using the pDEF38 expression vector described in Example 2.

EXAMPLE 6

Figure 3A:
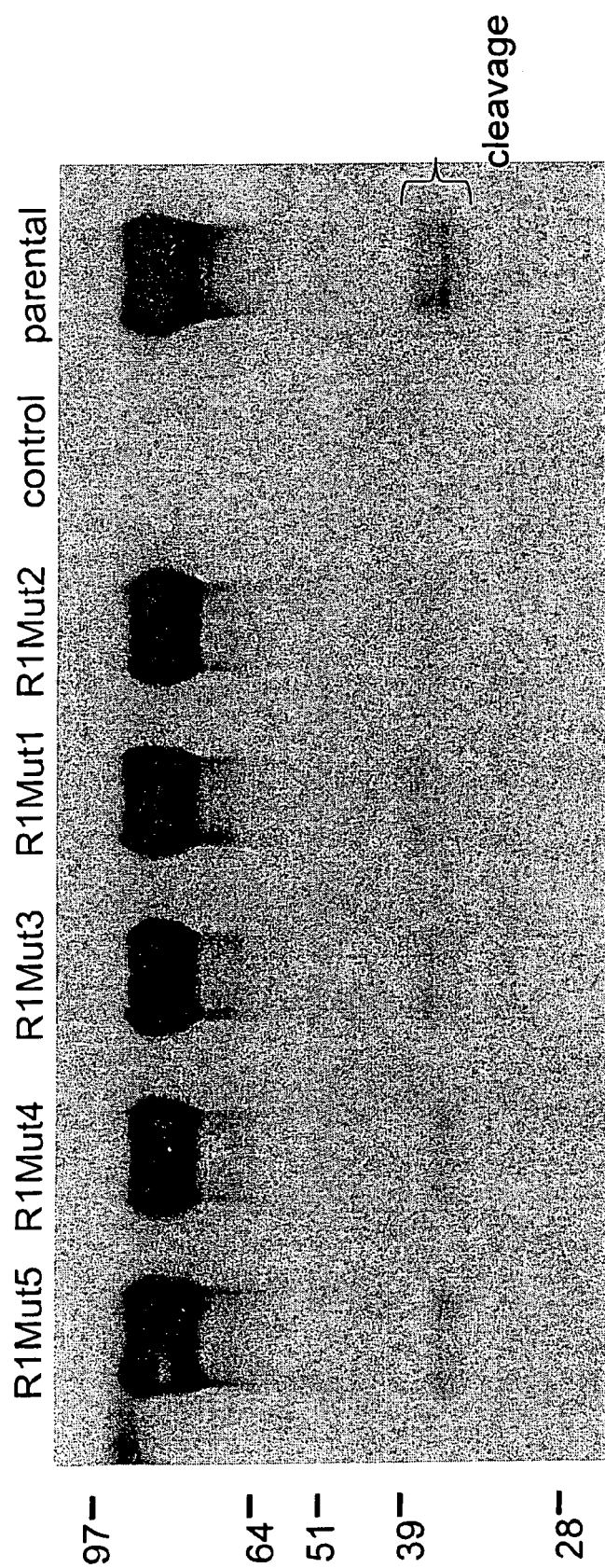
FIG. 3A shows a Western blot demonstrating that R1Mut1, R1Mut2, R1Mut3, R1Mut4, and R1Mut5 were more resistant to proteolytic cleavage by MMP-2 than the parental FGFR1-IIIc-Fc.

Analysis of In Vitro Cleavage of FGFR1-IIIc-Fc, R1Mut4 and other FGFR1-IIIc-Fc Variants During Cell Culture Production The resistance of FGFR1-IIIc-Fc to in vitro cleavage during transient protein expression was compared to the FGFR1-IIIc-Fc variants R1Mut1, R1Mut2, R1Mut3, R1Mut4, R1Mut5, R1Mut6, R1Mut7, R1Mut8 and R1Mut9. Fusion proteins were each expressed in 293-6E cells via transient transfection using the pTT5 vector as described in Example 2. The supernatants of each transfectant were collected on day four post-transfection and about 5 ul of each was separated with SDS-PAGE in a 4-12% acrylamide gel under reducing conditions. The supernatants were from cultures that were matched for cell number, viability, and transfection conditions. The separated proteins were then probed with horseradish-peroxidase conjugated anti-human Fc antibody (anti-human Fc HRP; Jackson ImmunoResearch Laboratories, Inc.; West Grove, Pa.). The results are shown in FIG. 3A, which shows the Fc fragment cleaved from the parental FGFR1-IIIc-Fc migrating between approximately 28 and 39 kD. Much less Fc product was cleared when the fusion protein was made with the truncation variants R1Mut1, R1Mut2, R1Mut3, R1Mut4, and R1Mut5. Similar experiments demonstrated that the variants of FGFR1-IIIc-Fc R1Mut6, R1Mut7, also had less in vitro cleavage during transient protein expression than the parental FGFR1-IIIc-Fc fusion protein.

Figure 3B:
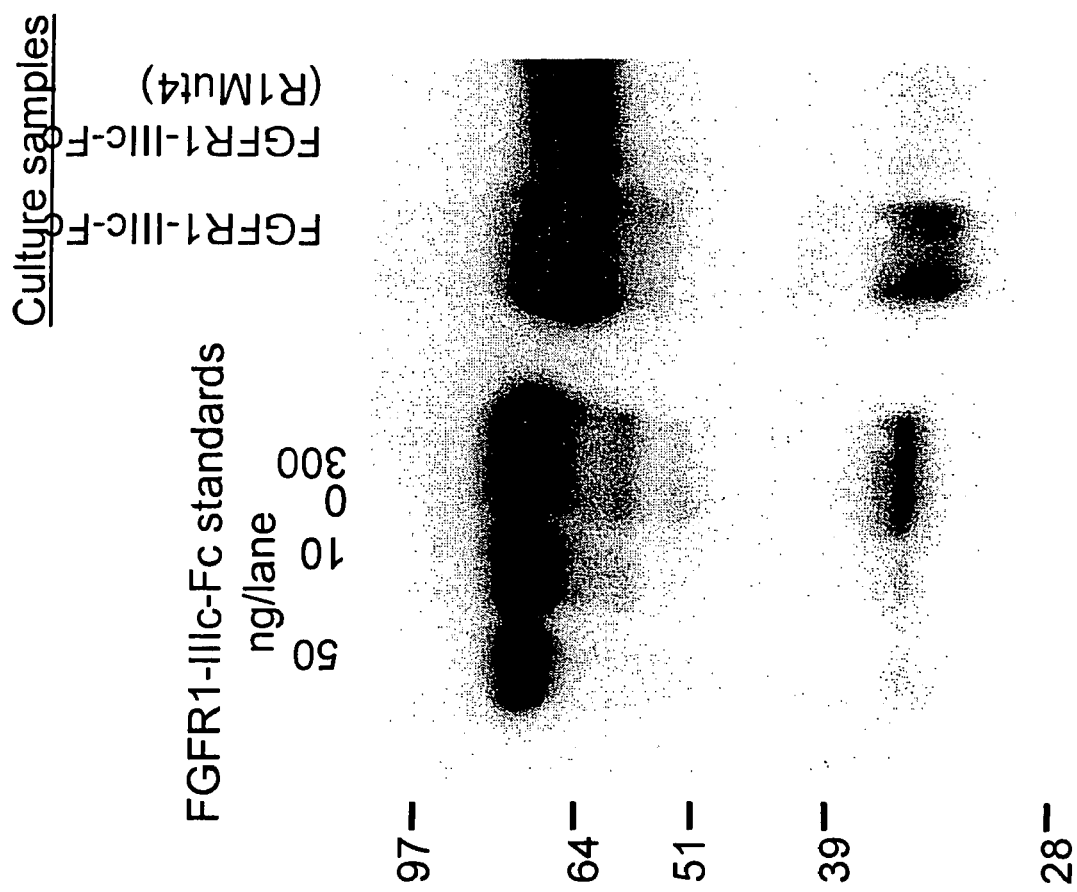
FIG. 3B shows a quantitative Western blot demonstrating that R1Mut4 is more resistant to MMP-2 cleavage, compared to parental FGFR1-IIIc-Fc. Quantitative standards of FGFR1-IIIc-Fc are shown on the left and cell culture medium from FGFR1-IIIc-Fc and R1Mut4 are shown on the right.

To compare the in vitro cleavage of FGFR1-IIIc-Fc and R1Mut4 produced from stably transfected DG44 host cells, pooled supernatants from cultures of cells producing FGFR1-IIIc-Fc and R1Mut4 having similar cell viability (82.9% for FGFR1-IIIc-Fc and 79.2% for R1Mut4), the same cultivation period (four days), and having similar cell densities ($0.95 \times 10^6$/ml for FGFR1-IIIc-Fc and $0.65 \times 10^6$/ml for R1Mut4). The expressed recombinant proteins were separated on a 4-12% Bis-Tris PAGE gel (Bio-Rad; Hercules, Calif.) and subsequently transferred to a nitrocellulose membrane. The intact molecule, as well as the cleaved product of free human Fc fragment, was visualized by Western blot using goat anti-human Fc antibody (Jackson ImmunoResearch Laboratories, Inc.; West Grove, Pa.). The results are shown in FIG. 3B. The left panel of the Western blot shows 50 ng, 100 ng, and 300 ng of purified FGFR1-IIIc-Fc protein produced from CHO-S cells. The right panel shows a comparison of FGFR1-IIIc-Fc and R1Mut4 supernatants produced from DG44 cells, revealing the presence of an Fc cleavage product from the FGFR1-IIIc-Fc but little or no Fc cleavage product from the R1Mut4. These results indicate that R1Mut4 was more resistant to proteolysis and had less product cleaved during production than its parent molecule FGFR-IIIc-Fc.

Figure 4:
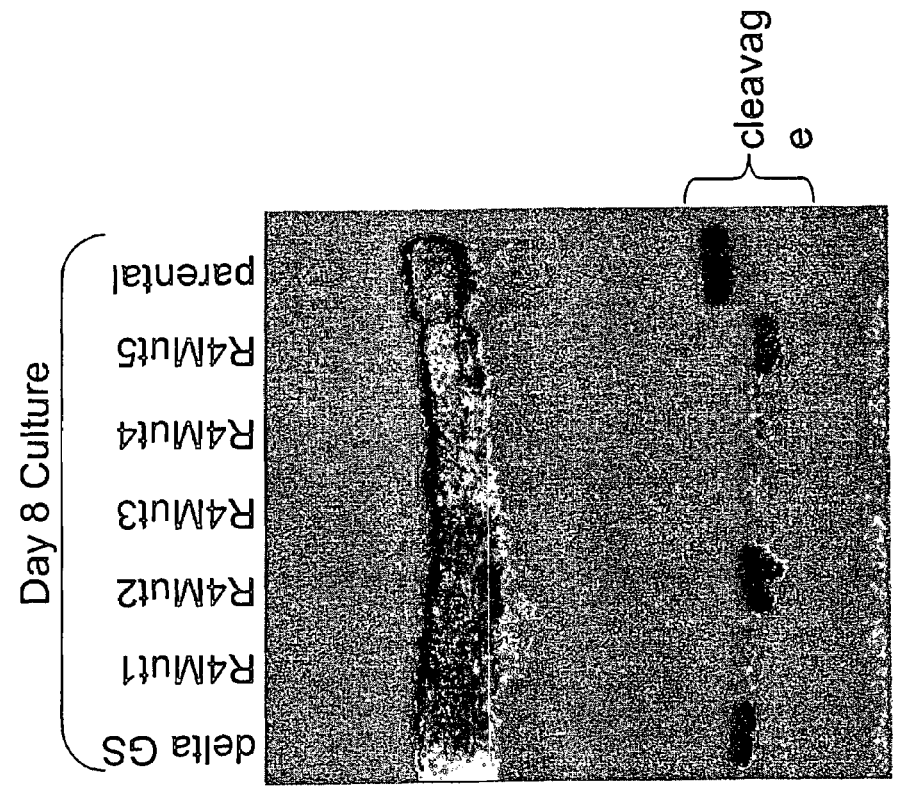
FIG. 4 shows a Western blot demonstrating that R4Mut1, R4Mut2, R4Mut3, R4Mut4, and R4Mut5 were more resistant to proteolytic cleavage by MMP-2 than the full-length parental FGFR4-Fc.
Figure 4:
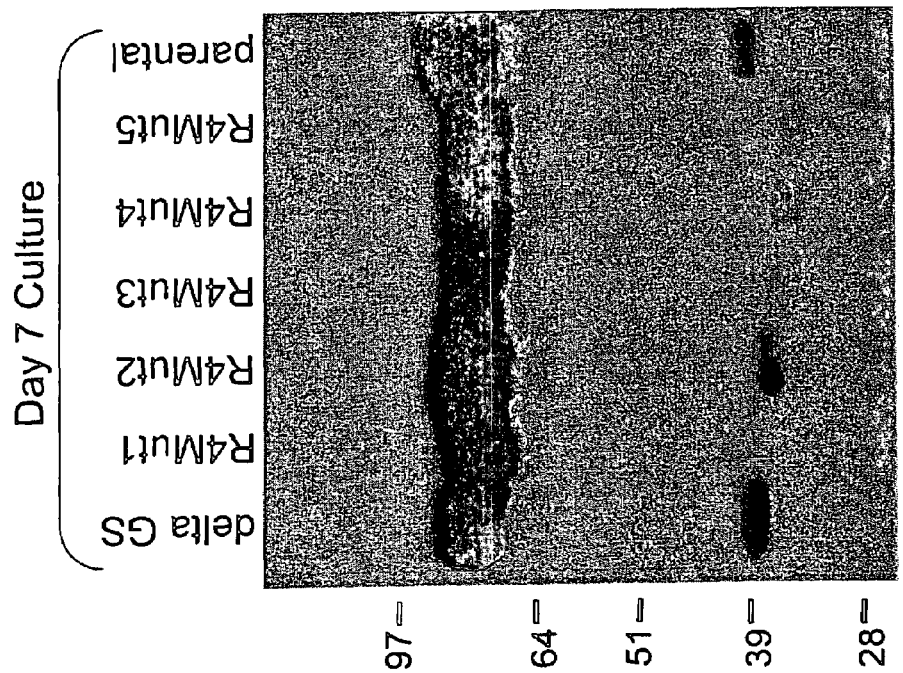

The resistance of parental FGFR4-Fc to in vitro cleavage during transient protein expression was compared to the FGFR4-Fc variants R4Mut1, R4Mut2, R4Mut3, R4Mut4, R4Mut5, and R4Mut6 (delta GS). Fusion proteins were each expressed in 293-6E cells via transient transfection using the pTT5 vector and the techniques described in Example 2. The supernatants of each transfectant were collected on days seven and eight post-transfection and about 5 ul of each was separated by SDS-PAGE in a 4-12% acrylamide gel under reducing conditions. The supernatants were obtained from cultures matched for cell number, viability, and transfection conditions. The separated proteins were then probed with horseradish-peroxidase conjugated anti-human Fc antibody (anti-human Fc HRP; Jackson ImmunoResearch Laboratories, Inc., West Grove, Pa.). The results are shown in FIG. 4. The Fc fragment was cleaved from the parental FGFR4-Fc and migrated between approximately 30 and 43 kD. Much less Fc product cleaved when the fusion protein was made with the truncation variants R4Mut1, R4Mut3, and R4Mut4 compared to the parental construct, R4Mut2, R4Mut5, and R4Mut6.

EXAMPLE 7

Purification of FGFR IIIc-Fc

FGFR1-IIIc-Fc expressed from recombinant host cells was purified from cell culture supernatant using a combination of Protein-A affinity chromatography and butyl hydrophobic interaction chromatography. The components of the media were separated first on a Protein-A Sepharose column, then on a butyl Sepharose column using a GE Healthcare Akta Purifier 100 (GE Healthcare Bio-Sciences; Piscataway, N.J.). The Protein-A Sepharose 4 Fast Flow (GE Healthcare Bio-Sciences; Piscataway, N.J.) was used as an affinity matrix to bind to the Fc region of the fusion molecule. The column was equilibrated with ten column volumes of a sterile buffer of 10 mM potassium phosphate, 500 mM NaCl, pH 7.0; then the cell culture supernatant fluid was applied to the column. The column was washed with eight column volumes of sterile 10 mM potassium phosphate, 500 mM NaCl buffer, pH 7.0; then the bound material, including FGFR1-IIIc-Fc, was eluted at a rate of 10 ml/min with a step gradient of the elution buffer (100 mM glycine, 500 mM NaCl, pH 2.7) using sequential steps of two column volumes each of 15%, 30%, 45%, 60%, 75%, and 90% elution buffer, followed by five column volumes of 100% elution buffer. Ten-ml fractions were collected in tubes containing one ml 1 M Tris pH 7.0 (Ambion; Austin, Tex.) to neutralize the eluates. Fractions comprising FGFR1-IIIc-Fc were identified by gel electrophoresis and pooled. FGFR1-IIIc-Fc was eluted at approximately 30-45% gradient-strength elution buffer.

Pooled Protein—A column eluates comprising the bulk of FGFR1-IIIc-Fc were then subjected to further purification by butyl Sepharose hydrophobic interaction chromatography. Following the addition of an equal volume of 2.4 M ammonium sulfate to the eluate from the Protein-A column, the eluate was applied to a Butyl Sepharose 4 Fast Flow column (GE Healthcare Bio-Sciences; Piscataway, N.J.) that had been equilibrated with five column volumes of sterile 10 mM potassium phosphate, 1.2 M ammonium sulfate, pH 7.0. The column was washed with four column volumes of the equilibration buffer and the bound material was eluted at a rate of five ml/min with a linear gradient starting at 100% equilibration buffer and ending at 100% of the elution buffer (10 mM potassium phosphate, 30 nM NaCl, pH 7.0) over a total volume of 13 column volumes followed by an additional five column volumes 100% elution buffer. Fractions (14 ml) were collected and the fractions containing the bulk of FGFR1-IIIc-Fc were identified by gel electrophoresis and pooled. FGFR1-IIIc-Fc was eluted with approximately 20-50% elution buffer.

After purification, endotoxin levels were checked by the limulus amoebocyte lysate (LAL) assay (Cambrex; Walkersville, Md.). When the values were higher than 1 endotoxin unit (EU)/mg of FGFR1-III-Fc protein, further purification was performed by Cellufine™ ET Clean chromatography (Chisso Corporation; Tokyo, Japan) following the manufacturer's instructions, FGFR1-IIIc-Fc was dialyzed with PBS and applied to a Cellufine™ ET Clean column (10×0.9 cm (I.D.); 9.6 ml) previously equilibrated with PBS, and the protein was collected in the flow through at a flow rate of 0.5 ml/min. The final FGFR1-IIIc-Fc solution (in PBS without $Ca^{2+}/Mg^{2+}$) was then re-tested to confirm a value less than or equal to 1 EU/mg of protein as assessed by the LAL assay.

These purification protocols were used to purify other FGFR-Fc fusion proteins and variants, such as FGFR3-IIIc-Fc and R1Mut4. These purification protocols may also be used to purify other FGFR-Fc fusion proteins and variants, and may be adjusted using methods known in the art to substantially purify FGFR-Fc fusion proteins, for example, other FGFR1-Fc fusion protein variants, FGFR2-Fc fusion proteins and variants, FGFR3-IIIc-Fc fusion protein variants, and FGFR4-Fc proteins and variants. For example, components of the cell culture supernatant media may be separated by hydrophobic chromatography either prior to or subsequent to the Protein-A step. Both the Protein-A and hydrophobic chromatography can take place in a column, a slurry, or other similar embodiments. The column size may depend on the amount of FGFR-Fc estimated to be present in the cell culture supernatant, for example, 25 liters of CHO cell supernatant media transfected with FGFR1-IIIc-Fc produced about 8 mg/L, or 200 mg of substantially pure FGFR1-IIIc-Fc, using the protocol described above.

EXAMPLE 8

Specificity and Affinity of Ligand Binding to FGFR1-IIIc-Fc, R1Mut4, FGFR3-IIIc-Fc, and FGFR4Measured by Biacore Analysis The specificity of FGF ligand binding to FGFR1-IIIc-Fc, R1Mut4, FGFR3-IIIc-Fc, and FGFR4-Fc was assessed using Biacore® T100 surface plasmon resonance (SPR) technology (Biacore; Piscataway, N.J.). FGFR1-IIIc-Fc, R1Mut4, and FGFR4-Fc fusion proteins were produced from CHO-S host cells as described in Examples 2, 4, and 5. FGFR3-IIIc-Fc fusion protein was produced from 293-6E host cells as described in Examples 2 and 3. Protein-A was covalently linked to a CM5 chip, according to manufacturer's instructions and then a FGFR fusion protein was bound to the chip by the interaction of the Fc domain with the Protein-A. The FGF ligands were placed in contact with the FGFR fusion protein, also according to manufacturer's instructions, in the presence of HBS-P buffer (Biacore; Piscataway, N.J.) supplemented with 50 ug/ml heparin (Sigma; St. Louis, Mo.).

All the recombinant FGF ligands were from R&D Systems (Minneapolis, Minn.) except for FGF-18 which was from Wako Chemicals (Richmond, Va.). FGF ligands were each tested at six to eight concentrations ranging from 4.5 ng/ml to 10 ug/ml. The FGF ligands were recombinant and of human origin, except for FGF8b and FGF-18, which were of recombinant mouse origin.

Figure 32:
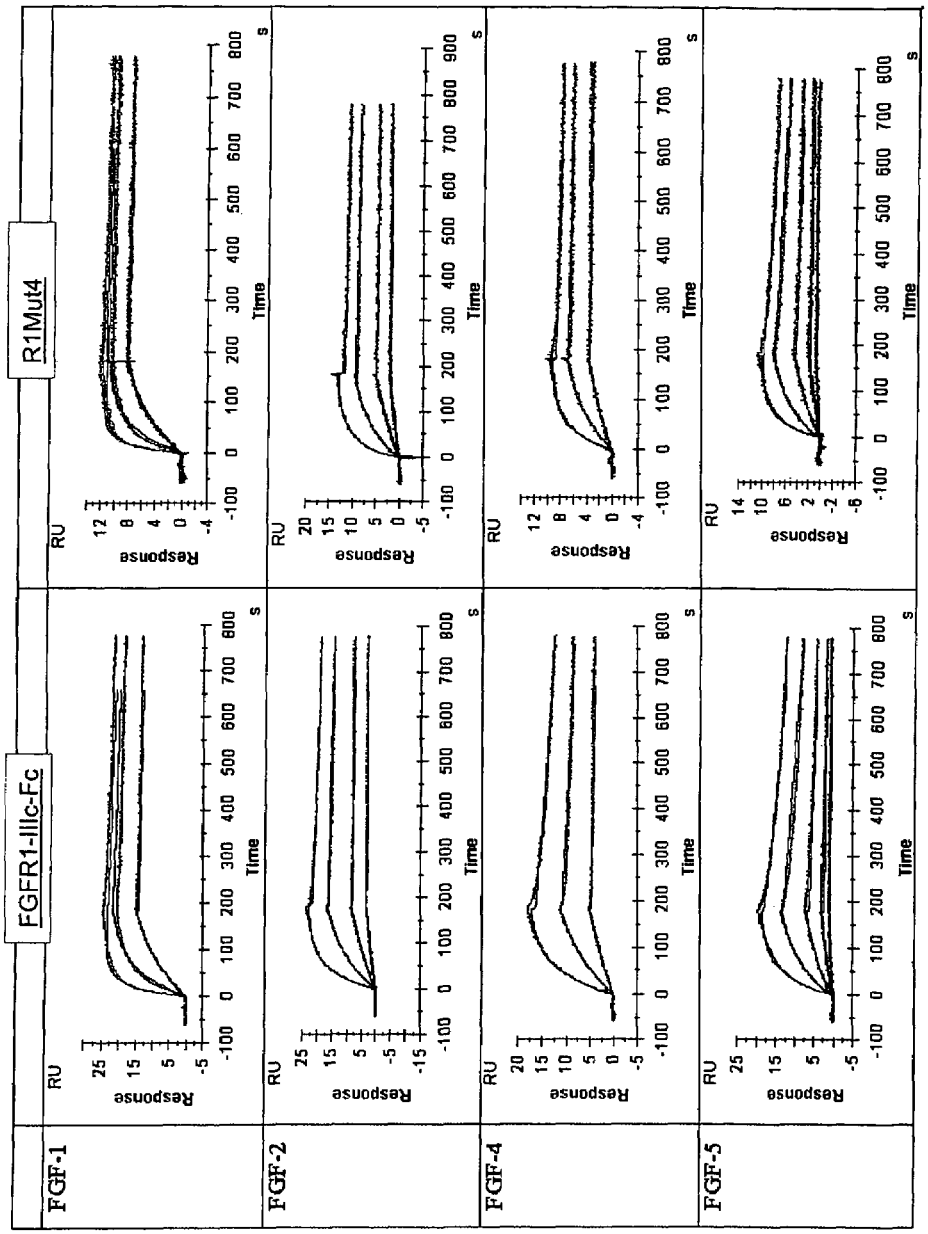
FIG. 32 shows the real-time ligand binding profiles of FGFR1-IIIc-Fc and R1Mut4 to FGF-1, FGF-2, FGF-4, and FGF-5, measured by surface plasmon resonance.

The binding of FGFR1-IIIc-Fc, R1Mut4, FGFR3-IIIc-Fc, and FGFR4-Fc to various FGF ligands was measured in real time. FIG. 32 shows several representative binding traces from the experiments with FGFR1-IIIc-Fc and R1Mut4 and Table 3 below shows the resulting association constants ($k_a$), dissociation constants ($k_d$) and equilibrium dissociation constants ($K_D$) that were determined from these studies.

As summarized in Table 8-1, the relative rank of FGF binding affinity to FGFR1-IIIc-Fc was FGF-1>FGF-18>FGF-2, FGF-4>FGF-9, FGF-20>FGF-5>FGF-19. The relative rank of FGF binding affinity to R1Mut4 was FGF-1>FGF-4, FGF-18>FGF-2>FGF20>FGF-9>FGF-5>FGF-19. The relative rank of FGF binding affinity to FGFR3-IIIc-Fc was FGF-18>FGF-1>FGF-9>FGF-2, FGF-4>FGF-20>FGF-5>FGF-7>FGF-19. The relative rank of FGF binding affinity to FGFR4-Fc was FGF-1>FGF-2.

In another binding study between FGFR4-Fc and the various FGFs, conducted in a similar fashion as described above, the resulting equilibrium dissociation constants ($K_D$) and the relative rank of FGF binding affinity for FGFR4-Fc were: FGF-18 ($K_D$ of $0.4 \times 10^{-9}$ M)>FGF-17 ($K_D$ of $1.0 \times 10^{-9}$ M)= FGF-20 ($K_D$ of $1.2 \times 10^{-9}$ M)>FGF-8 ($K_D$ of $3.9 \times 10^{-9}$ M)=FGF-4 ($K_D$ of $4.6 \times 10^{-9}$ M)>FGF-9 ($K_D$ of $9.8 \times 10^{-9}$ M)=FGF-16 ($K_D$ of $9.7 \times 10^{-9}$ M)>FGF-19 ($K_D$ of $12.3 \times 10^{-9}$ M)>FGF-1 ($K_D$ of $16.3 \times 10^{-9}$ M)>FGF-6 CD of $26.2 \times 10^{-9}$ M)>FGF-2 ($K_D$ of $44.2 \times 10^{-9}$ M)>FGF-3 ($K_D$ of $51.8 \times 10^{-9}$ M). FGF-5 showed no binding in this experiment.

The affinity of R1Mut4 for all the ligands tested except FGF-19 was greater than that of the parental FGFR1-IIIc-Fc molecule. In addition, the relative rankings of ligand affinities were also different between R1Mut4 and the parental FGFR1-IIIc-Fc molecule.

About 40 ul of the above fusion proteins pre-incubated with FGF-1 were then added to the washed half-well plates coated with FGFR4-Fc and incubated for 30 min at 37° C. with shaking. After incubation, the plates were washed as before six times with PBS and 0.05% Tween-20 to remove any unbound FGF-1. After washing, about 2 ug/ml of anti-human FGF-1 polyclonal biotinylated antibody (R&D Systems; Minneapolis, Minn.) in 1× BLOTTO was added to each well of the plate, which was then incubated for 30 min at 37° C. with shaking, followed by washing as before to remove any unbound anti-FGF-1 antibody. The bound anti-FGF-1 antibody was detected using a streptavidin-HRP linker provided in the ABC kit (Vector Laboratories; Burlingame, Calif.)

TABLE 3

Real-Time Ligand Binding to FGFRs

| Ligand | $k_a$ | $k_d$ | $K_D$ | $k_a$ | $k_d$ | $K_D$ |
|---|---|---|---|---|---|---|
| | FGFR1-IIIc-Fc | | | R1Mut4 | | |
| FGF-1 | $2.00 \times 10^6$ M* | $1.99 \times 10^{-4}$ M | $9.95 \times 10^{-11}$ M | $3.46 \times 10^6$ M* | $1.61 \times 10^{-4}$ M* | $5.07 \times 10^{-11}$ M* |
| FGF-2 | $3.75 \times 10^5$ M | $2.31 \times 10^{-4}$ M | $6.17 \times 10^{-10}$ M | $4.12 \times 10^5$ M | $1.80 \times 10^{-4}$ M | $4.38 \times 10^{-10}$ M |
| FGF-4 | $7.15 \times 10^5$ M | $4.77 \times 10^{-4}$ M | $6.67 \times 10^{-10}$ M | $1.06 \times 10^6$ M | $2.26 \times 10^{-4}$ M | $2.14 \times 10^{-10}$ M |
| FGF-5 | $1.71 \times 10^5$ M | $7.85 \times 10^{-4}$ M | $4.58 \times 10^{-9}$ M | $3.71 \times 10^5$ M | $9.65 \times 10^{-4}$ M | $2.95 \times 10^{-9}$ M |
| FGF-7 | n.d | | n.d | n.d | n.d | n.d |
| FGF-9 | $4.74 \times 10^5$ M | $5.29 \times 10^{-4}$ M | $1.12 \times 10^{-9}$ M | $5.66 \times 10^5$ M | $5.20 \times 10^{-4}$ M | $9.19 \times 10^{-10}$ M |
| FGF-18 | $1.11 \times 10^6$ M* | $4.41 \times 10^{-4}$ M* | $4.18 \times 10^{-10}$ M* | $1.06 \times 10^6$ M* | $2.77 \times 10^{-4}$ M* | $2.75 \times 10^{-10}$ M* |
| FGF-19 | $5.63 \times 10^4$ M | $4.43 \times 10^{-1}$ M | $7.87 \times 10^{-6}$ M | n.m. | n.m. | n.m. |
| FGF-20 | $1.62 \times 10^5$ M | $2.55 \times 10^{-4}$ M | $1.57 \times 10^{-9}$ M | $2.42 \times 10^5$ M | $1.90 \times 10^{-4}$ M | $7.85 \times 10^{-10}$ M |
| | FGFR3-IIIc-Fc | | | FGFR4-Fc | | |
| FGF-1 | $2.83 \times 10^6$ M* | $3.31 \times 10^{-4}$ M* | $1.26 \times 10^{-10}$ M* | $1.68 \times 10^5$ M | $5.78 \times 10^{-4}$ M | $3.45 \times 10^{-9}$ M |
| FGF-2 | $3.36 \times 10^5$ M | $1.37 \times 10^{-3}$ M | $1.06 \times 10^{-9}$ M | $4.16 \times 10^4$ M | $6.73 \times 10^{-4}$ M | $1.62 \times 10^{-8}$ M |
| FGF-4 | $8.08 \times 10^5$ M | $1.55 \times 10^{-3}$ M | $1.91 \times 10^{-9}$ M | n.m. | n.m. | n.m. |
| FGF-5 | $2.31 \times 10^5$ M | $1.69 \times 10^{-3}$ M | $9.70 \times 10^{-9}$ M | n.d | n.d | n.d |
| FGF-7 | $3.19 \times 10^5$ M | $4.71 \times 10^{-2}$ M | $1.48 \times 10^{-7}$ M | n.d | n.d | n.d |
| FGF-9 | $7.76 \times 10^5$ M | $4.17 \times 10^{-4}$ M | $5.37 \times 10^{-10}$ M | n.d | n.d | n.d |
| FGF-18 | $5.16 \times 10^6$ M* | $1.80 \times 10^{-4}$ M* | $3.50 \times 10^{-11}$ M* | n.d | n.d | n.d |
| FGF-19 | $5.63 \times 10^4$ M | $4.43 \times 10^{-1}$ M | $7.87 \times 10^{-6}$ M | n.d | n.d | n.d |
| FGF-20 | $1.85 \times 10^5$ M | $4.04 \times 10^{-4}$ M | $2.17 \times 10^{-9}$ M | n.d | n.d | n.d |

*= average of two independent measurements
n.d. = not determined
n.m. = not measurable

EXAMPLE 9

Specificity and Affinity of Ligand Binding to FGFR4-Fc and FGFR4-Fc Deletion Mutants Measured by Competition ELISA FGFR4-Fc fusion protein and deletion variants, made as described in Examples 1, 2, and 3, were tested for their ability to sequester the soluble FGF ligands FGF-1, FGF-2, and FGF-8b, and to inhibit ligand binding to FGFR4-Fc fusion protein coated on a plate.

Briefly, HI BIND half-wells were coated with FGFR4-Fc of CHO-S-origin at a concentration of 5 ug/ml in PBS in a volume of 25 ul per well for 1 hr at room temperature. The wells were blocked by adding 150 ul BLOTTO per well and incubating for 2 hr at room temperature. The coated half-well plates were then washed six times with PBS and 0.05% Tween-20 to remove unbound FGFR1-IIIc-Fc and BLOTTO.

Varying amounts of FGFR4-Fc fusion protein and the deletion variants, produced from CHO-S cells, or 10 ug/ml of the negative control human IgG (Caltag; Burlingame, Calif.) were each first pre-incubated in 96-well U-bottom plates with 60 ng/ml recombinant human FGF-1 (from R&D Systems; Minneapolis, Minn.) in 50 ul for 30 min at 37° C. on a shaker in the presence of 20 ug/ml heparin in 0.1× BLOTTO in PBS.

according to manufacturer's protocol. After washing as before, reconstituted (OPD) solution (Sigma; St. Louis, Mo.) was added. The detection reaction proceeded for 10 to 20 min at room temperature and was followed by a reading of the absorbance at 450 nm. The binding curves from the competition ELISA and the resulting $EC_{50}$ values are shown in FIG. 5A.

Figure 5A:
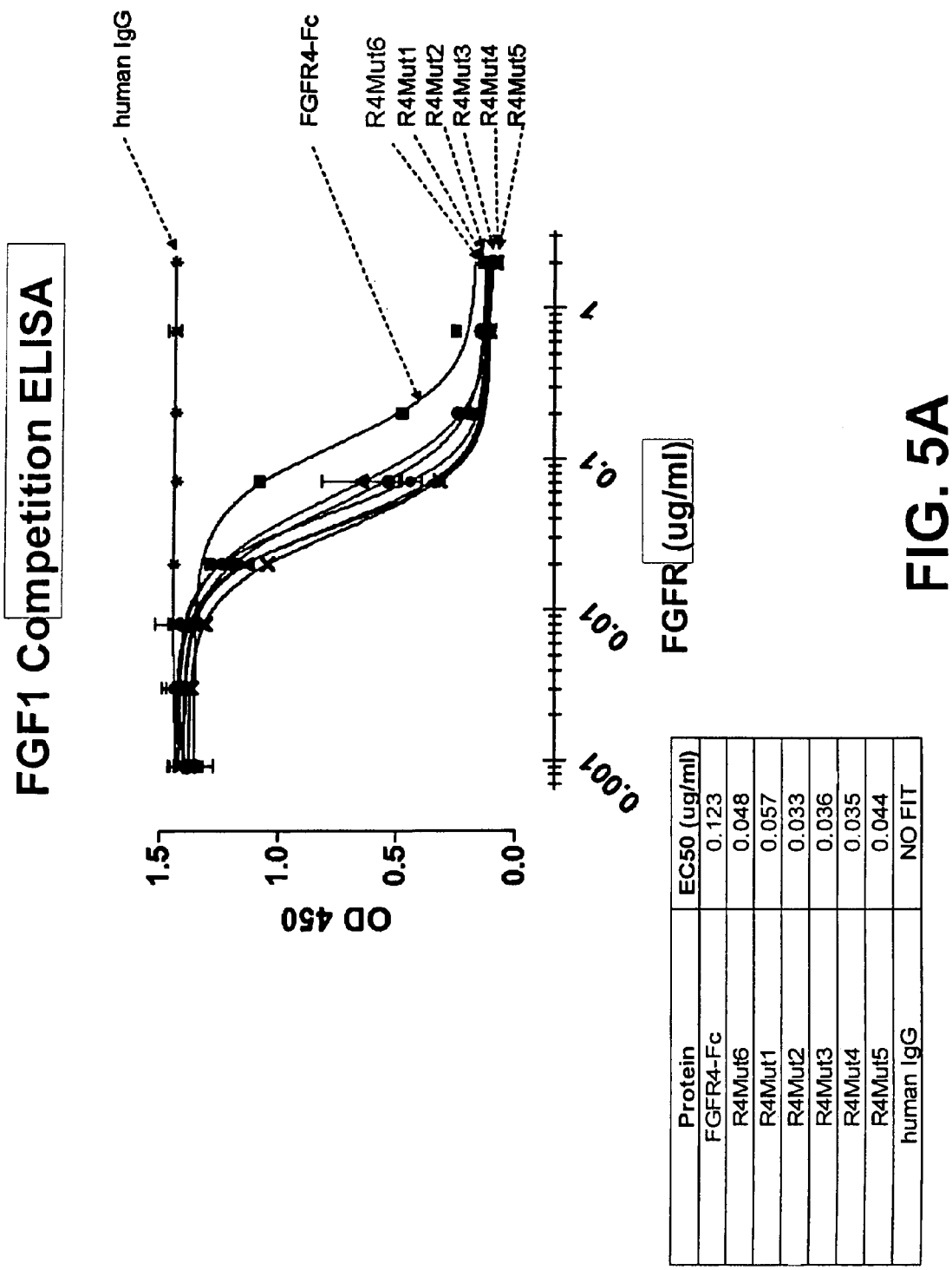
FIG. 5A shows a competition ELISA assay measuring the binding of increasing concentrations (ug/ml) of FGFR4 mutants to FGF-1 by measuring changes in $OD_{450}$. R4Mut1, R4Mut2, R4Mut3, R4Mut4, R4Mut5, and R4Mut6 each has a higher affinity for FGF-1 than the parental FGFR4-Fc, whereas human IgG did not bind to FGF-1.

FIG. 5A showed that the FGFR4 deletion variants R4Mut1, R4Mut2, R4Mut3, R4Mut4, R4Mut5, and R4Mut6 had higher affinities for FGF-1 than did the parental FGFR4-Fc. The FGFR4-Fc deletion variants had $EC_{50}$ values of about 0.033 ug/ml to about 0.057 ug/ml. In contrast, the parental FGFR4-Fc had an $EC_{50}$ value of about 0.123 ug/ml. The human IgG1 negative control did not inhibit FGF-1 binding to the FGFR4-Fc coated on the plate.

Similar competition ELISA experiments were conducted comparing the ability of the FGFR4-Fc fusion protein and the FGFR4-Fc deletion variants, produced in CHO-S host cells, to inhibit the binding of recombinant human FGF-2 (used at 200 ng/ml) and recombinant mouse FGF-8b (used at 200 ng/ml) (all from R&D Systems; Minneapolis, Minn.) to FGFR4-Fc derived from CHO-S cells and immobilized on an assay plate.

Figure 5B:
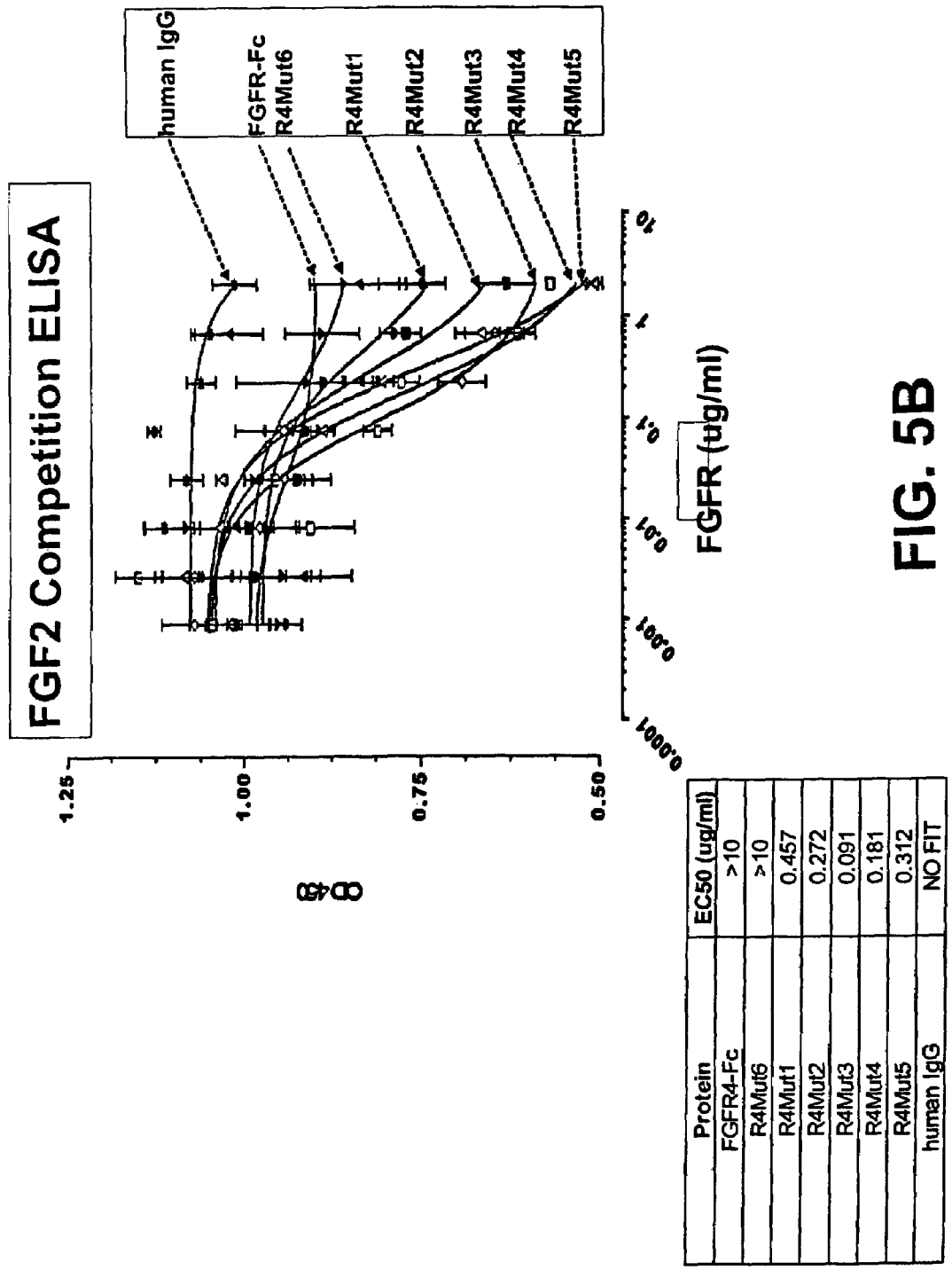
FIG. 5B shows a competition ELISA assay measuring the binding of increasing concentrations (ug/ml) of FGFR4 mutants to FGF-2 by measuring changes in $OD_{450}$. R4Mut1, R4Mut2, R4Mut3, R4Mut4, and R4Mut5 each has a higher affinity for FGF-2 than the parental FGFR4-Fc, whereas human IgG did not bind to FGF-2.

FIG. 5B showed that the FGFR4 deletion variants R4Mut1, R4Mut2, R4Mut3, R4Mut4, and R4Mut5 had higher affinities for FGF-2 than did the parental FGFR4-Fc. The FGFR4-Fc deletion variants R4Mut1, R4Mut2, R4Mut3, R4Mut4, and R4Mut5 had $EC_{50}$ values from about 0.091 ug/ml to about 0.457 ug/ml, with R4Mut3 having the highest affinity for FGF-2; the $EC_{50}$ was about 0.091 ug/ml. In contrast, the parental FGFR4-Fc had an $EC_{50}$ value of greater than 10 ug/ml, as did the deletion variant R4Mut6. The human IgG1 negative control did not inhibit FGF-1 binding to plate-immobilized FGFR4-Fc.

Figure 5C:
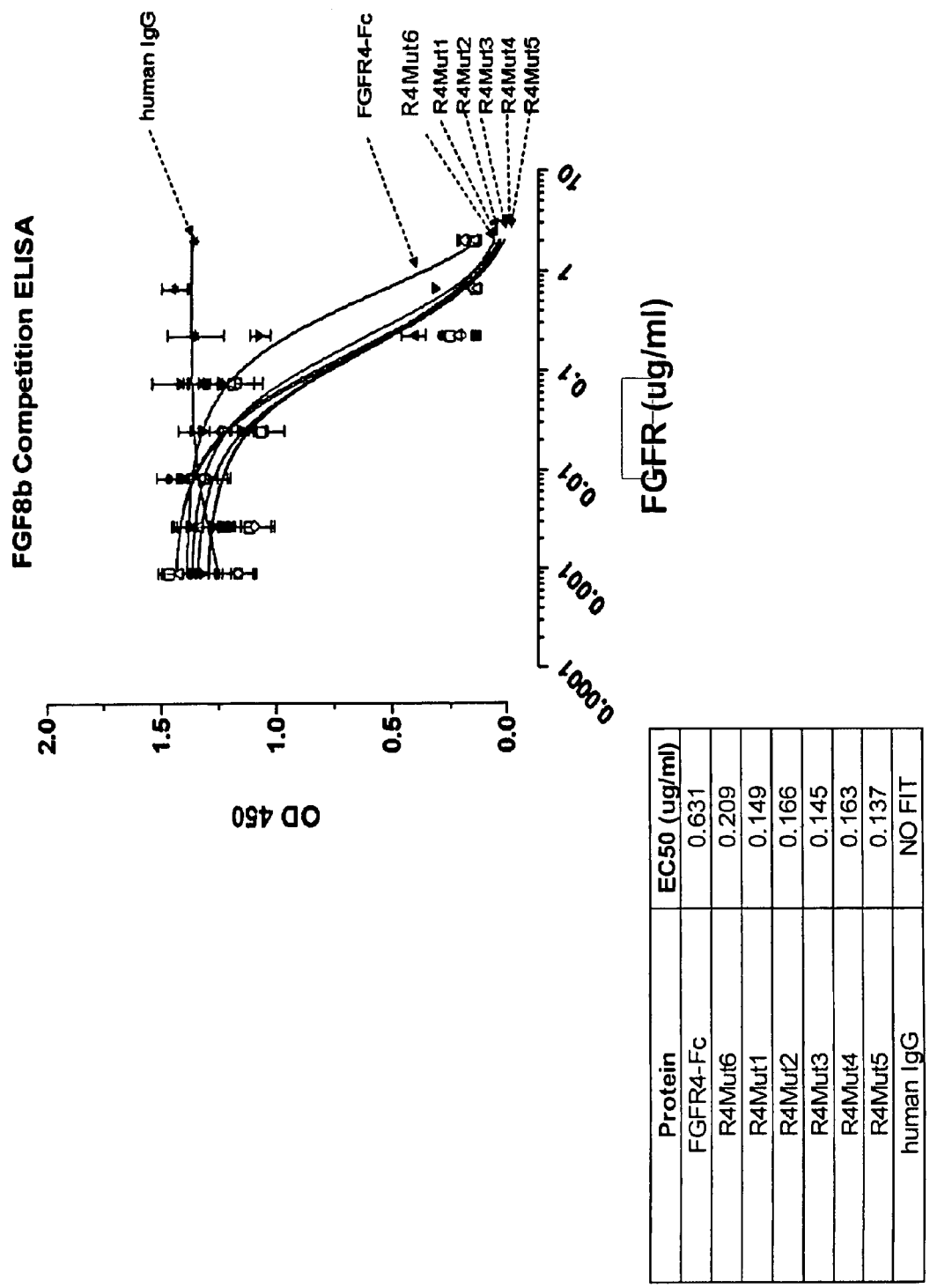
FIG. 5C shows a competition ELISA assay measuring the binding of increasing concentrations (ug/ml) of FGFR4 mutants to FGF-8b by measuring changes in $OD_{450}$. R4Mut1, R4Mut2, R4Mut3, R4Mut4, R4Mut5, and R4Mut6 each has a higher affinity for FGF-8b than parental FGFR4-Fc, whereas human IgG did not bind to FGF-1.

FIG. 5C showed that the FGFR4 deletion variants R4Mut1, R4Mut2, R4Mut3, R4Mut4, R4Mut5, and R4Mut6 had higher affinities for FGF-8b than did the parental FGFR4-Fc. The FGFR4-Fc deletion variants had $EC_{50}$ values of about 0.137 ug/ml to about 0.209 ug/ml. In contrast, the parental FGFR4-Fc had an $EC_{50}$ value of about 0.631 ug/ml. The human IgG1 negative control did not inhibit FGF-1 binding to the FGFR4-Fc coated on the plate.

These experiments demonstrated that the FGFR4 deletion mutants R4Mut1, R4Mut2, R4Mut3, R4Mut4 and R4Mut5 had a higher affinity than the parental FGFR4-Fc in their ability to inhibit FGF-1 (as shown in FIG. 5A), FGF-2 (as shown in FIG. 5B), and FGF-8b (as shown in FIG. 5C) binding to plate-immobilized FGFR4-Fc.

EXAMPLE 10

Affinity of Ligand Binding to FGFR1-IIIc-Fc Deletion Mutants Measured by Direct ELISA The R1Mut1, R1Mut2, R1Mut3, R1Mut4, and R1Mut5 fusion proteins were compared to parental FGFR1-IIIc-Fc fusion protein (all produced from 293-6E host cells as described in Example 3) for their ability to bind FGF-2 by a direct FGF-2 binding ELISA assay. Briefly, FGF-2 (R&D Systems; Minneapolis, Minn.) was used to coat half-well HI BIND wells (Becton Dickinson; Franklin Lakes, N.J.) by diluting FGF-2 in PBS at a concentration of 5 ug/ml in 25 ul volume per well and incubating for 1 hr at room temperature while shaking. The wells were then blocked by adding 150 ul of BLOTTO (Pierce Biotechnology; Rockford, Ill.) to each well and incubating for 1 hr at room temperature. The plates were then washed six times with PBS comprising 0.05% Tween-20 to remove the FGF-2 and BLOTTO and the wells were then incubated overnight at 4° C. with varying concentrations of FGFR1-IIIc-Fc, R1Mut1, R1Mut2, R1Mut3, R1Mut4, R1Mut5, or human IgG (as a negative control), in the presence of 10 ug/ml heparin diluted in 0.1× BLOTTO in PBS. The plates were washed as before, and then incubated with 25 ul of anti-human Fc antibody conjugated to HRP at 2.5 ug/ml in BLOTTO for 1 hr at room temperature on a plate shaker. The BLOTTO was then removed and the plates were again washed as before. After washing, the wells were incubated with reconstituted OPD solution (Sigma; Saint Louis, Mo.) for 10 to 20 min at room temperature and the absorbance at 450 nm was measured.

Figure 6:
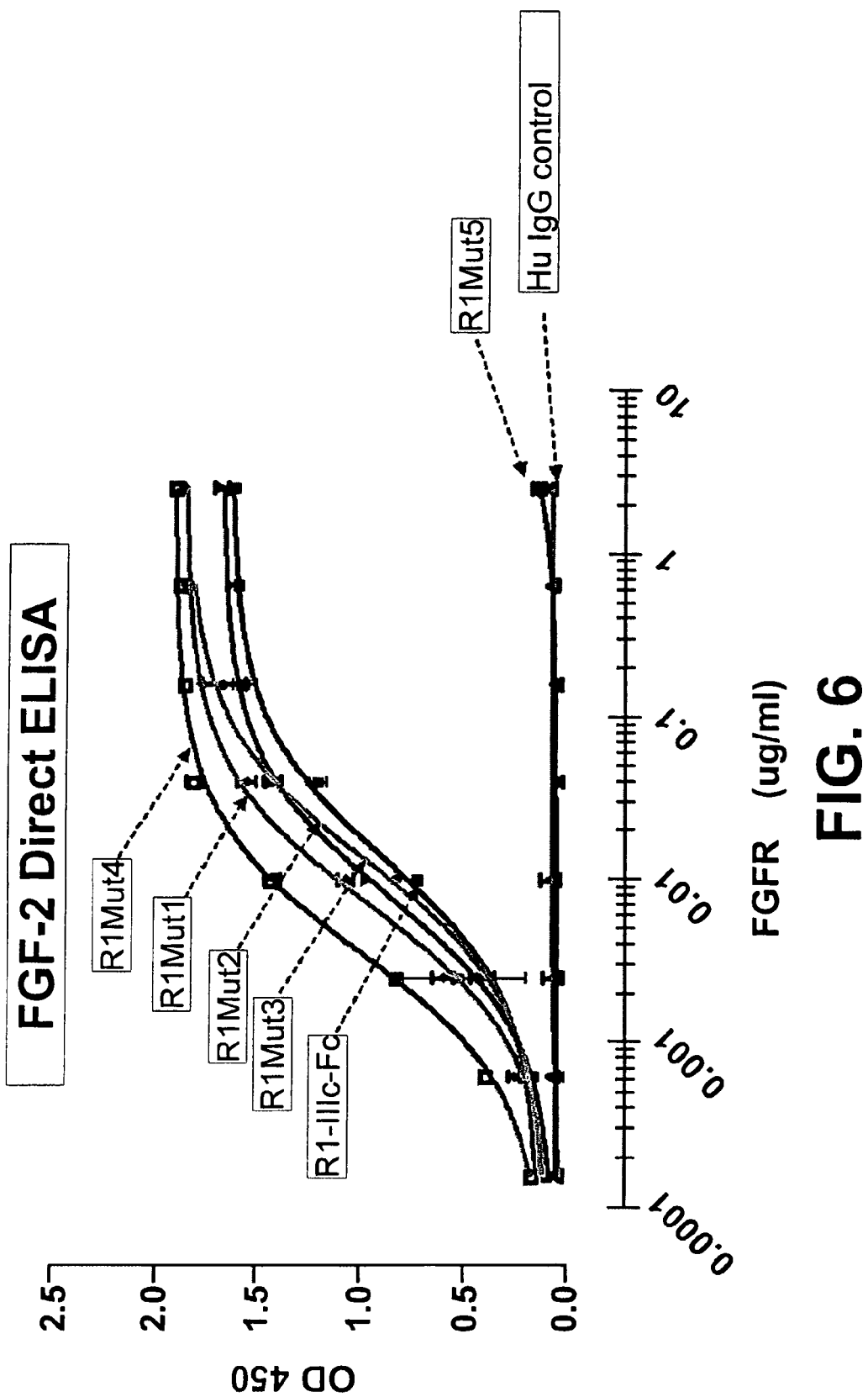
FIG. 6 shows a direct ELISA assay measuring the binding of increasing concentrations (ug/ml) of FGFR4 mutants to FGF-2 by measuring changes in $OD_{450}$. R1Mut1, R1Mut2, R1Mut3, and R1Mut4, but not R1Mut5, were able to bind FGF-2 as well as or better than parental FGFR1-IIIc-Fc.

As shown in FIG. 6, R1Mut1, R1Mut2, R1Mut3, and R1Mut4, but not R1Mut5, were each able to bind to FGF-2 as well as or better than the parental FGFR1-IIIc-Fc, with R1Mut4 having the highest apparent affinity of all the fusion proteins tested in this experiment. The MMP-2 cleavage site mutants R1Mut7, R1Mut8, and R1Mut9 (all produced in 293-6E host cells using the expression vector pTT5 as described in Example 2) also bound to FGF-2 with an affinity similar to that of parental FGFR1-IIIc-Fc.

EXAMPLE 11

FGFR Fusion Proteins Inhibit FGFR1-IIIc-Fc Ligand Binding

FGFR1-IIIc-Fc fusion proteins produced from 293-6E and CHO cells, made as described in Examples 1, 2, and 3, were tested in a competition ELISA assay for their ability to sequester the soluble FGF ligands FGF-1, FGF-2, and FGF-8b, and to inhibit ligand binding to FGFR1-IIIc-Fc fusion protein coated on a plate.

Briefly, HI BIND half-wells were coated with FGFR1-IIIc-Fc of 293-6E-origin at a concentration of 5 ug/ml in PBS in a volume of 25 ul per well for 1 hr at room temperature. The wells were blocked by adding 150 ul BLOTTO per well and incubating for 2 hr at room temperature. The coated half-well plates were then washed six times with PBS and 0.05% Tween-20 to remove unbound FGFR1-IIIc-Fc and BLOTTO.

Varying amounts of FGFR1-IIIc-Fc fusion proteins produced from 293-6E cells or CHO cells, or 10 ug/ml of the negative control human IgG (Caltag; Burlingame, Calif.) were each first pre-incubated in 96-well U-bottom plates with 200 ng/ml recombinant human FGF-2 (from R&D Systems) in 50 ul for 30 min at 37° C. on a shaker in the presence of 20 ug/ml heparin in 0.1× BLOTTO in PBS. About 40 ul of the above fusion proteins pre-incubated with FGF-2 were then added to the washed half-well plates coated with FGFR1-IIIc-Fc and incubated for 30 min at 37° C. with shaking. After incubation, the plates were washed as before six times with PBS and 0.05% Tween-20 to remove any unbound FGF-2. After washing, about 2 ug/ml of anti-human FGF-2 polyclonal biotinylated antibody (from R&D Systems) in 1× BLOTTO was added to each well of the plate, which was then incubated for 30 min at 37° C. with shaking, followed by washing as before to remove any unbound anti-FGF-2 antibody. The bound anti-FGF-2 antibody was detected using a streptavidin-HRP linker provided in the ABC kit (Vector Laboratories, Burlingame, Calif.) according to the manufacturer's protocol. After washing as before, reconstituted OPD solution (Sigma; St. Louis, Mo.) was added. The detection reaction was developed for 10 to 20 min at room temperature followed by a reading of absorbance at 450 nm. Results are shown in FIG. 7.

Figure 7:
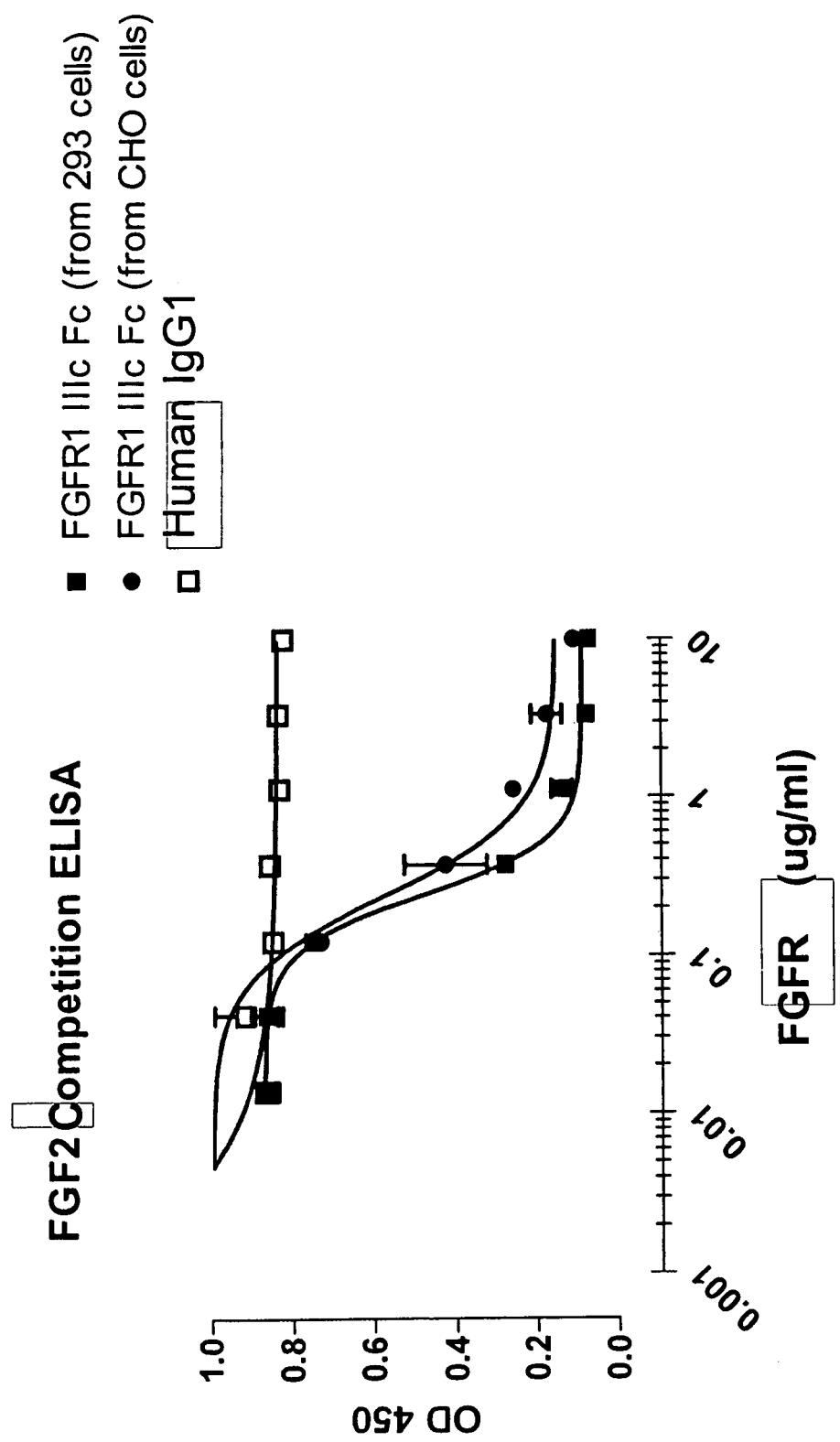
FIG. 7 shows a competition ELISA assay measuring the binding of increasing concentrations (ug/ml) of FGFR1 fusion proteins, produced in either 293-6E cells or CHO cells, to FGF-2. FGFR1-IIIc-Fc produced by either 293-6E or by CHO host cells was able to bind and sequester FGF-2 to approximately the same extent, whereas human IgG was not able to bind FGF-2.

FIG. 7 showed that FGFR1-IIIc-Fc produced from 293-6E and from CHO cells had approximately equivalent binding potencies in their ability to sequester FGF-2 in an FGF-2 competition assay. Each of the two fusion proteins exhibited an $EC_{50}$ value of about 0.24 ug/ml. In contrast, the human IgG1 negative control did not inhibit FGF-2 binding to the FGFR1-IIIc-Fc coated on the plate.

Figure 8A:
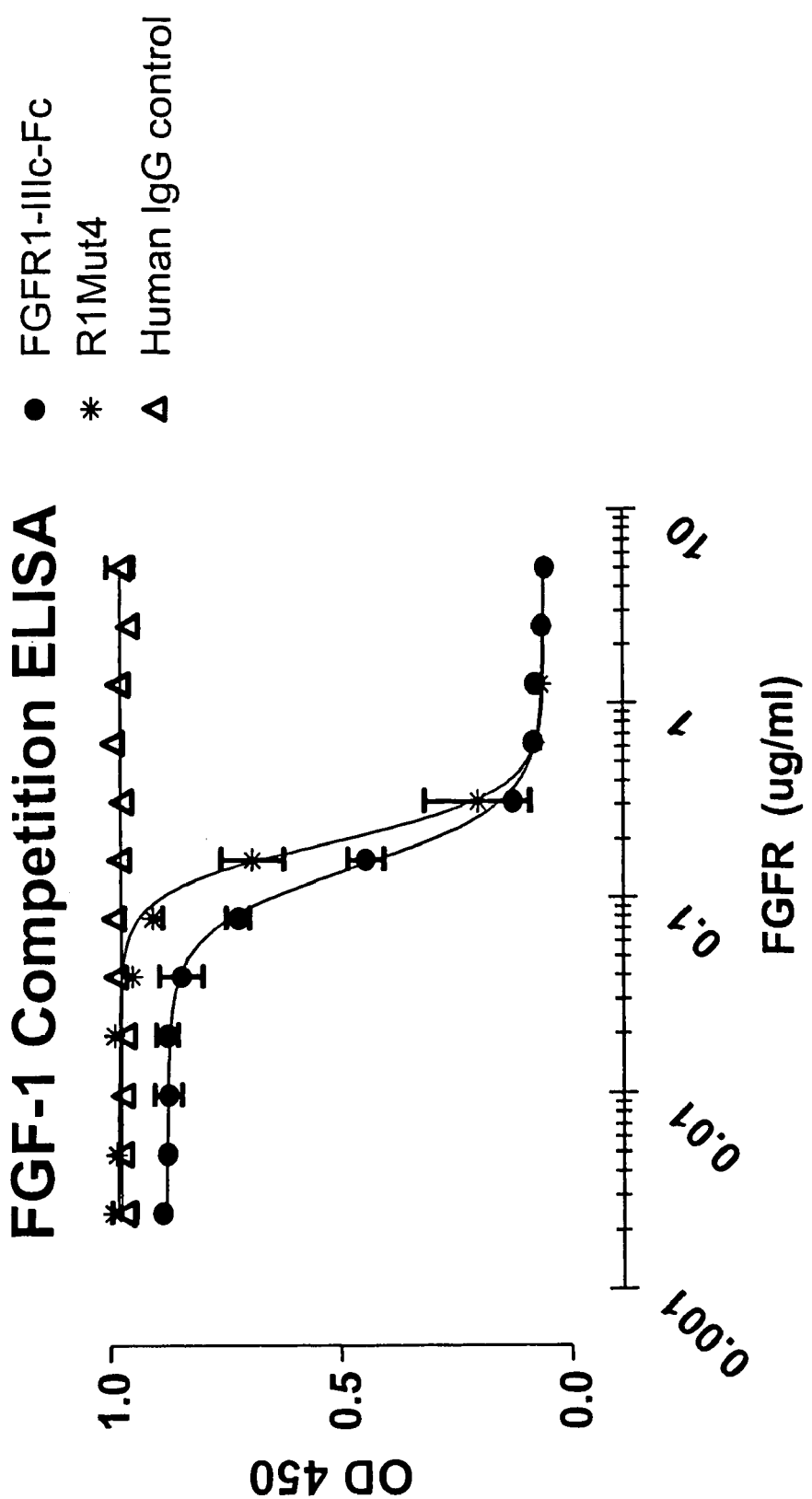
FIG. 8A shows a competition ELISA assay measuring the binding of increasing concentrations (ug/ml) of parental FGFR1-IIIc-Fc and R1Mut4, both produced by DG44 host cells, to FGF-1. Both FGFR1-IIIc-Fc and R1Mut4 were able to bind and sequester FGF-1 to approximately the same extent. Human IgG was not able to bind FGF-1.
Figure 8B:
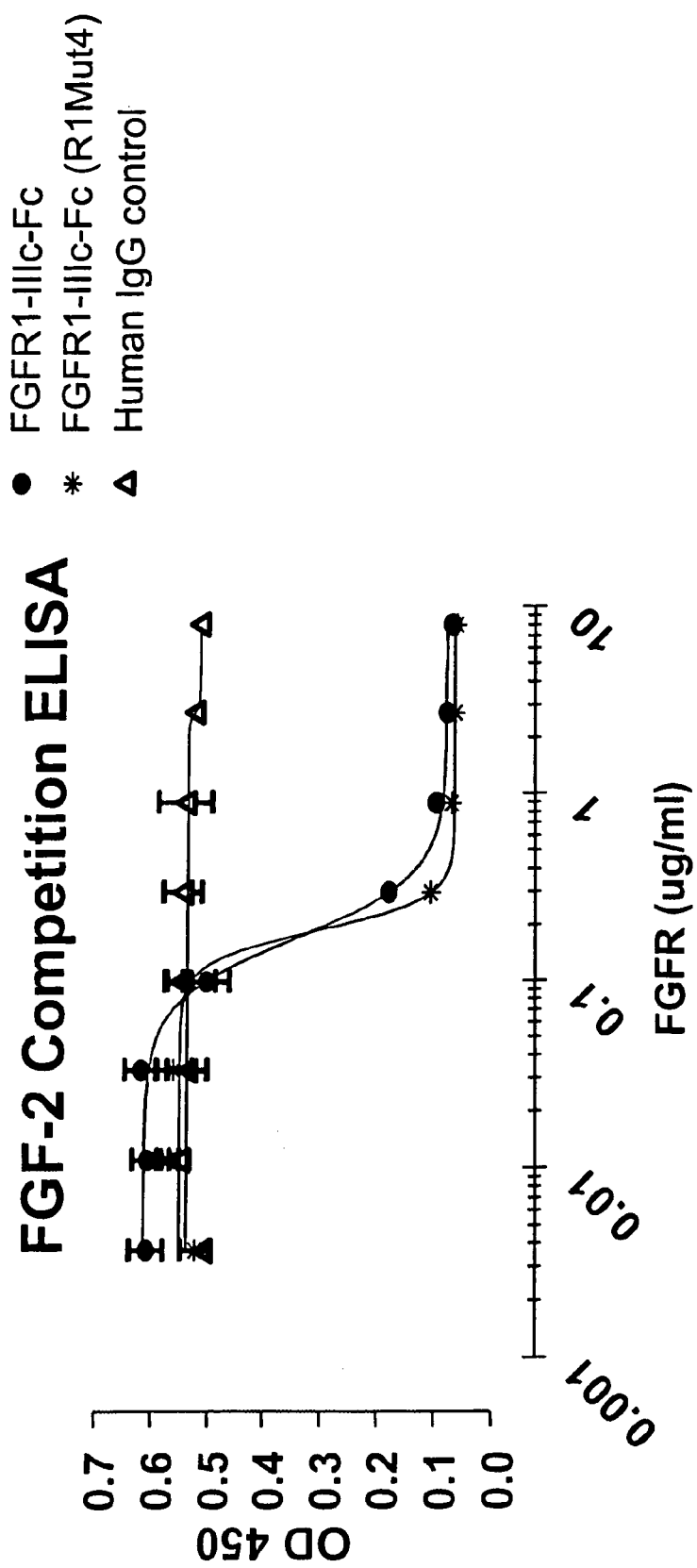
FIG. 8B shows a competition ELISA assay measuring the binding of increasing concentrations (ug/ml) of parental FGFR1-IIIc-Fc and R1Mut4, both produced by DG44 host cells, to FGF-2. Both FGFR1-IIIc-Fc and R1Mut4 were able to bind and sequester FGF-2 to approximately the same extent. Human IgG was not able to bind FGF-2.
Figure 9:
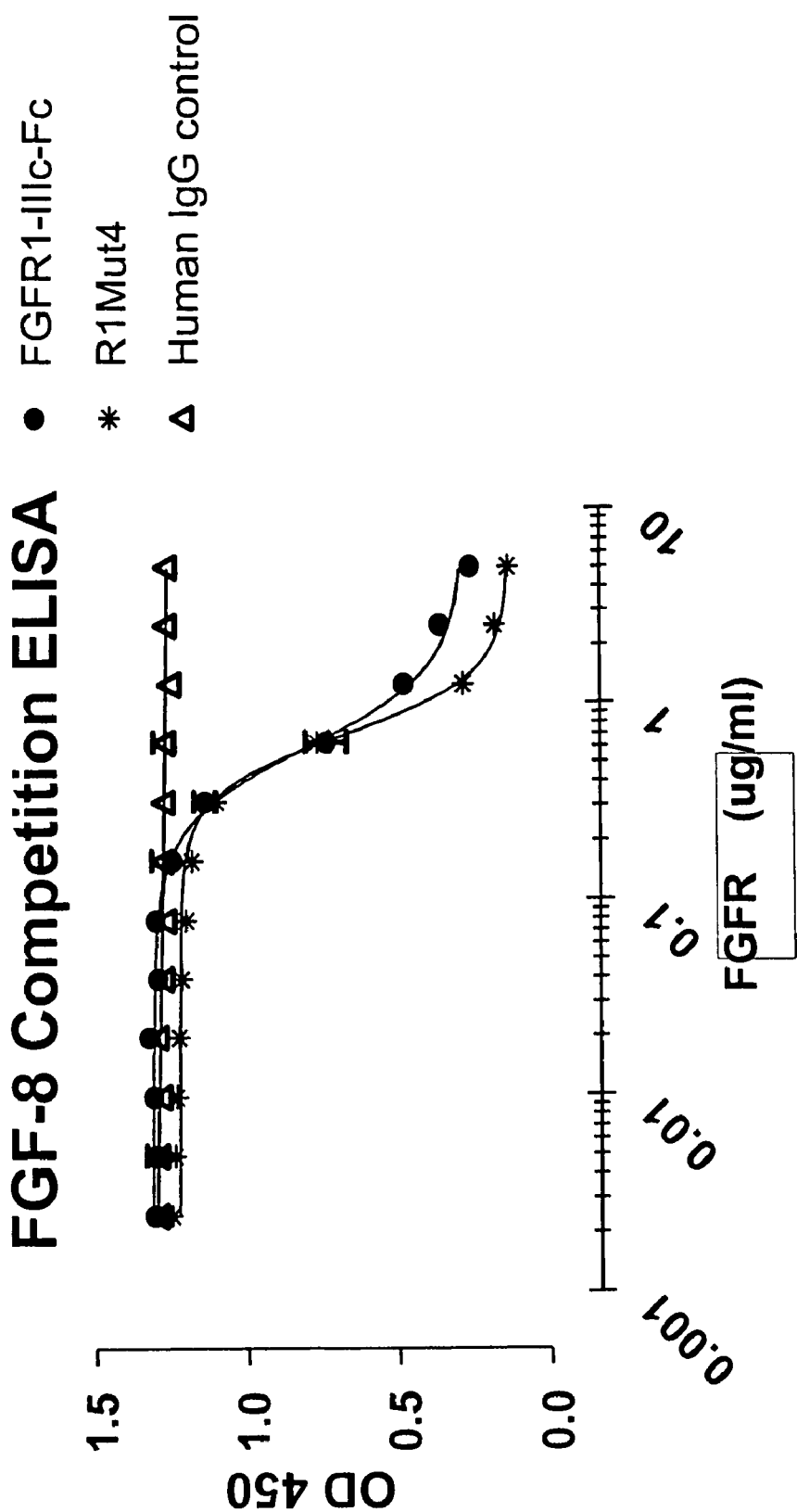
FIG. 9 shows a competition ELISA assay measuring the binding of increasing concentrations (ug/ml) of parental FGFR1-IIIc-Fc and R1Mut4, both produced by DG44 host cells, to FGF-8b. Both FGFR1-IIIc and RMut4 were able to bind and sequester FGF-8b to approximately the same extent. Human IgG was not able to bind FGF-8b.

Similar competition ELISA experiments were conducted comparing the ability of the FGFR1-IIIc-Fc fusion protein and R1Mut4 fusion protein, both produced in DG44 host cells, to inhibit the binding of recombinant human FGF-1 (at a concentration of 60 ng/ml), recombinant human FGF-2 (a concentration of at 200 ng/ml), and recombinant mouse FGF-8b (a concentration of at 200 ng/ml) (all from R&D Systems; Minneapolis, Minn.) to FGFR1-IIIc-Fc derived from 293 cells and immobilized on an assay plate. These experiments all demonstrated the equivalency of R1Mut4 and the parental FGFR1-IIIc-Fc fusion proteins in their ability to inhibit FGF-1 (as shown in FIG. 8A), FGF-2 (as shown in FIG. 8B), and FGF-8b (as shown in FIG. 9) binding to plate-immobilized FGFR1-IIIc-Fc.

Figure 11:
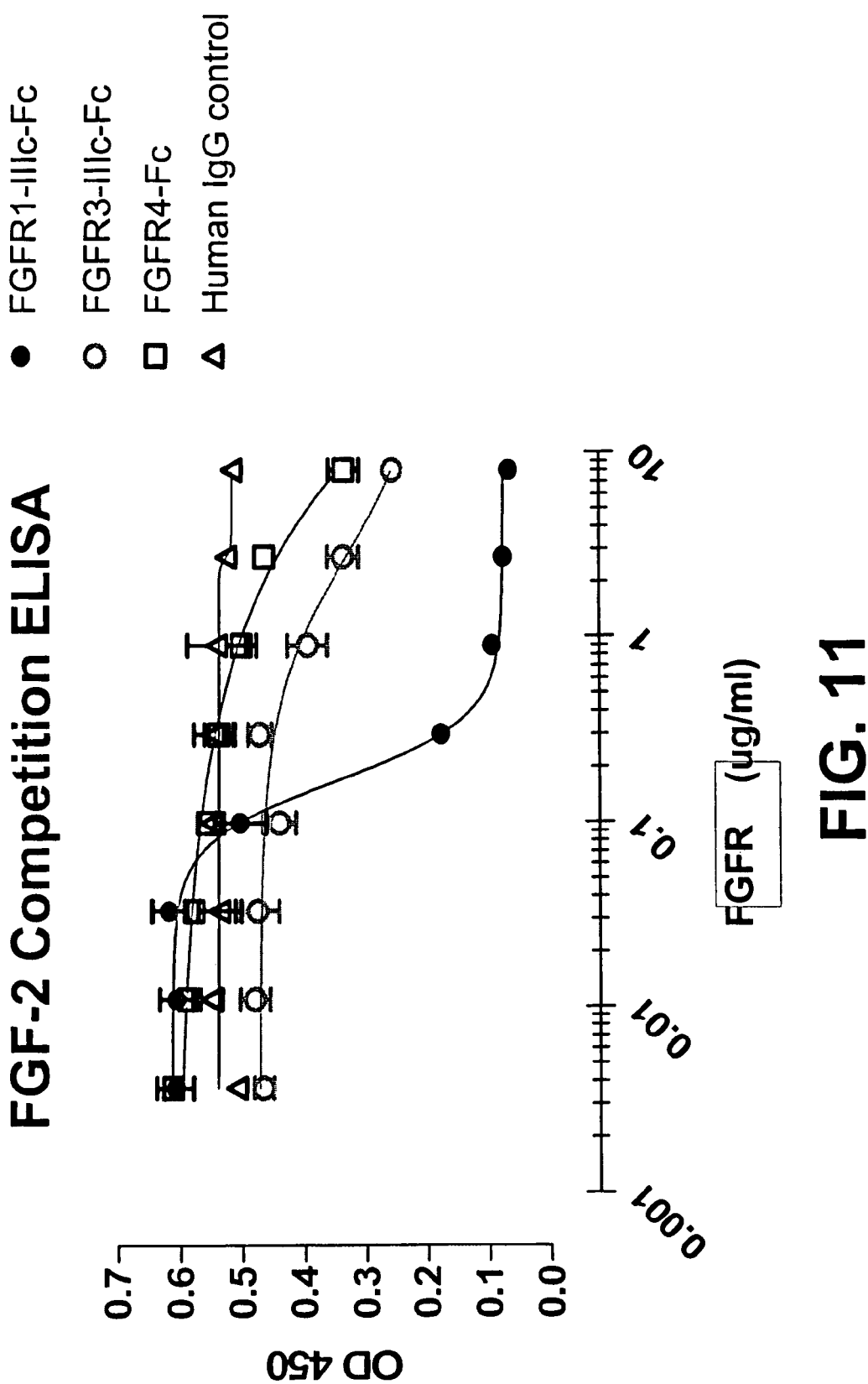
FIG. 11 shows a competition ELISA assay, as described in FIG. 10, measuring the ability of parental FGFR1-IIIc-Fc, FGFR3-IIIc-Fc, and FGFR4-Fc to inhibit FGF-2 binding to FGFR1-IIIc-Fc.
Figure 12:
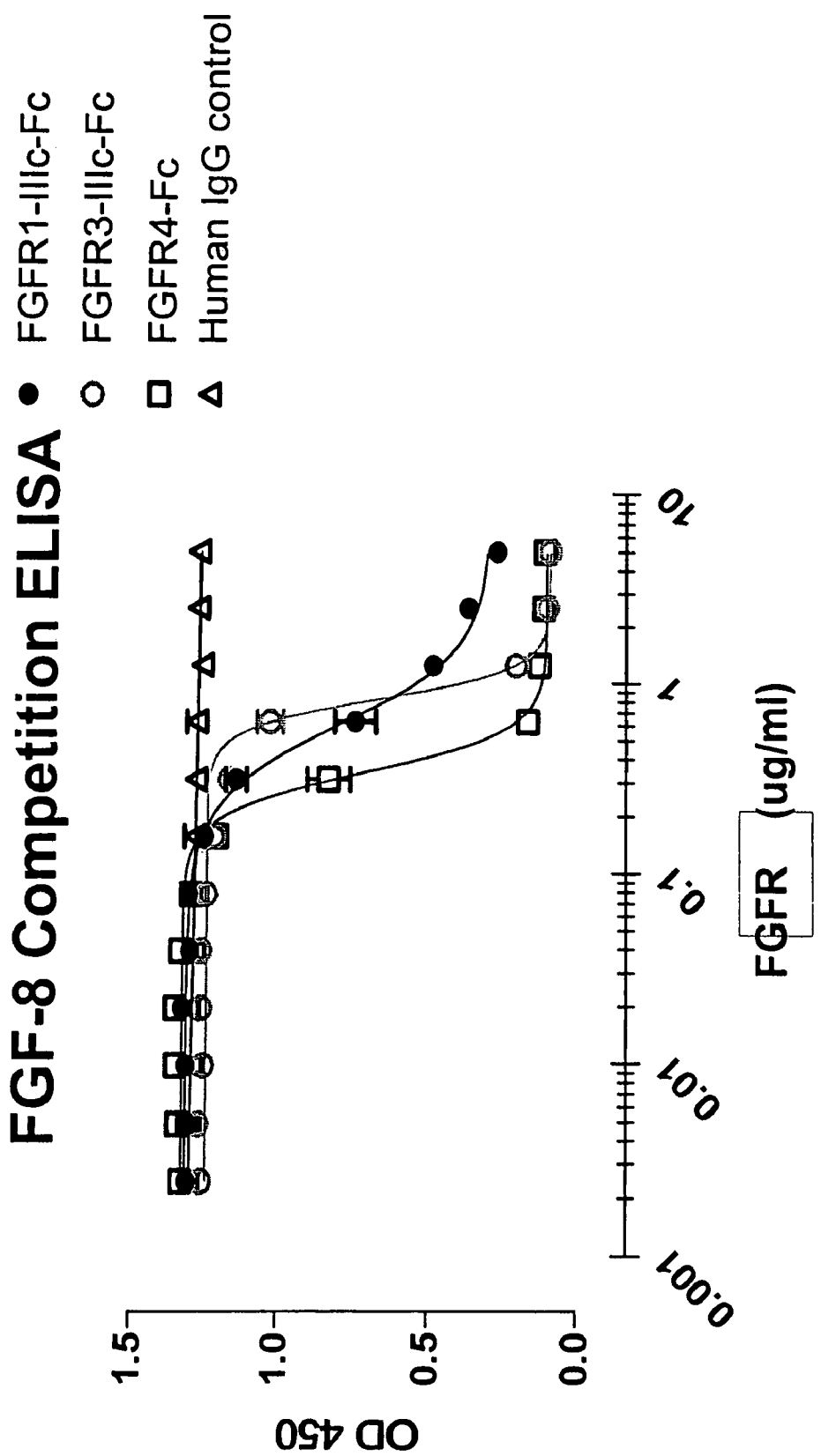
FIG. 12 shows a competition ELISA assay, as described in FIG. 11, measuring the ability of FGFR1-IIIc-Fc, FGFR3-IIIc-Fc, and FGFR4-Fc to inhibit FGF-8 binding to FGFR1-IIIc-Fc.

FGFR1-IIIc-Fc produced in DG44 host cells and FGFR3-IIIc-Fc and FGFR4-Fc produced in 293-6E host cells also inhibited ligand binding to FGFR1-IIIc-Fc produced in 293 cells and immobilized on an assay plate. A competition ELISA assay conducted as described above used recombinant human FGF-1, recombinant human FGF-2, and recombinant mouse FGF-8b (all from R&D Systems; Minneapolis, Minn.). Human IgG was used as a negative control. The results are shown in FIG. 10, FIG. 11, and FIG. 12, which demonstrate both the effectiveness of the decoy fusion proteins in blocking ligand-receptor binding and the specificity of the fusion proteins for their respective ligands.

Figure 10:
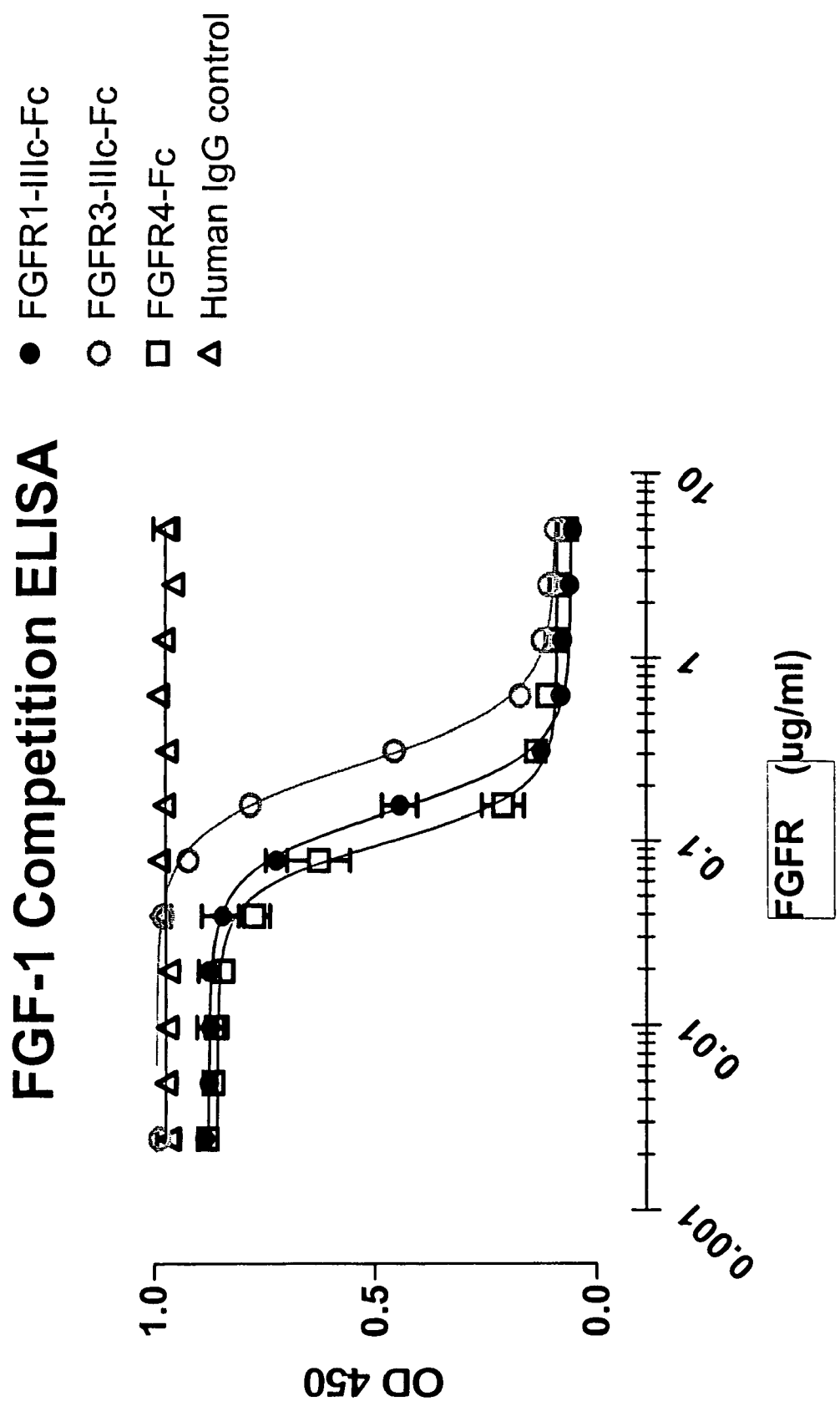
FIG. 10 shows a competition ELISA assay measuring the ability of increasing concentrations (ug/ml) of parental FGFR1-IIIc-Fc, FGFR3-IIIc-Fc, and FGFR4-Fc to inhibit FGF-1 binding to FGFR1-IIIc-Fc.

FIG. 10 showed that FGFR1-IIIc-Fc, FGFR3-IIIc-Fc, and FGFR4-Fc all inhibited FGF-1 binding to FGFR1-IIIc-Fc immobilized on an assay plate. FIG. 11 showed that FGFR3-IIIc-Fc and FGFR4-Fc were much less effective than FGFR1-IIIc-Fc in inhibiting FGF-2 binding to FGFR1-IIIc-Fc immobilized on an assay plate. FIG. 12 showed that FGFR1-IIIc-Fc, FGFR3-IIIc-Fc, and FGFR4-Fc were all similarly effective in inhibiting FGF-8 binding to FGFR1-IIIc-Fc immobilized on a plate.

EXAMPLE 12

FGFR1-IIIc-Fc Inhibited Phospho-Erk Signaling by FGF-2

FGFR1-IIIc-Fc fusion protein derived from 293-6E or CHO cells were approximately equally potent in inhibiting biological signaling by FGF-2. L6 cells transfected with FGFR1-IIIc (ETH; Zurich, Switzerland) growing in a T-175 flask were trypsinized, washed and seeded at a concentration of 10,000 cells/well in a volume of 100 ul in Dulbecco's modified Eagle's medium (DMEM) supplemented with 0.5% FCS and 0.1% bovine serum albumin (BSA) in 96-well flat-bottom plates for 16 hr. Activation medium containing FGFR1-IIIc-Fc fusion proteins or human IgG1, at concentrations from 0.005 to 10 ug/ml, was prepared (in 0.1% BSA DMEM containing 100 ng/ml FGF-2, 10 ug/ml heparin) and incubated for 30 min at 37° C. on a plate shaker. The L6 cells were then exposed to 25 ul of activation medium/well for 5 min at 37° C. The cells were then washed once with 200 ul of ice-cold PBS and lysed with 100 ul of ice-cold 1× lysis buffer for 30 min on ice following the manufacture's recommendations for the PathScan Phospho-p44/42 MAPK (T202/Y204) Sandwich ELISA Kit (Cell Signaling; Danvers, Mass.). At the end of the lysis period, the lysates were pipetted up and down approximately five times while minimizing foaming. About 80 ul of Sample Diluent (from Pathscan Sandwich ELISA kit) was added to each well of the phospho-ERK ELISA plate, then topped by 80 ul of cell lysate and mixed. The plate was sealed with plastic adhesive, incubated for 2 hr at 37° C., and washed six times with PBS containing 0.05% Tween-20. Then 100 ul of phospho-ERK Detection Antibody (from Pathscan Sandwich ELISA kit) was added to each well. The plate was sealed with adhesive cover, incubated for 1 hr at 37° C., washed as before and 100 ul of HRP-linked secondary antibody (from Pathscan Sandwich ELISA kit) was added to each well. The plate was again sealed, incubated for 30 min at 37° C., and then washed as before. About 100 ul of TMB substrate (3,3', 5,5'-tetramethylbenzidine, from Pathscan Sandwich ELISA kit) was then added to each well and the plate was incubated for 30 min at 25° C. The color development was completed by adding 100 ul of STOP Solution (from Pathscan Sandwich ELISA kit) to each well and mixing. The absorbance at 450 nm was recorded and plotted as shown in FIG. 13.

Figure 13:
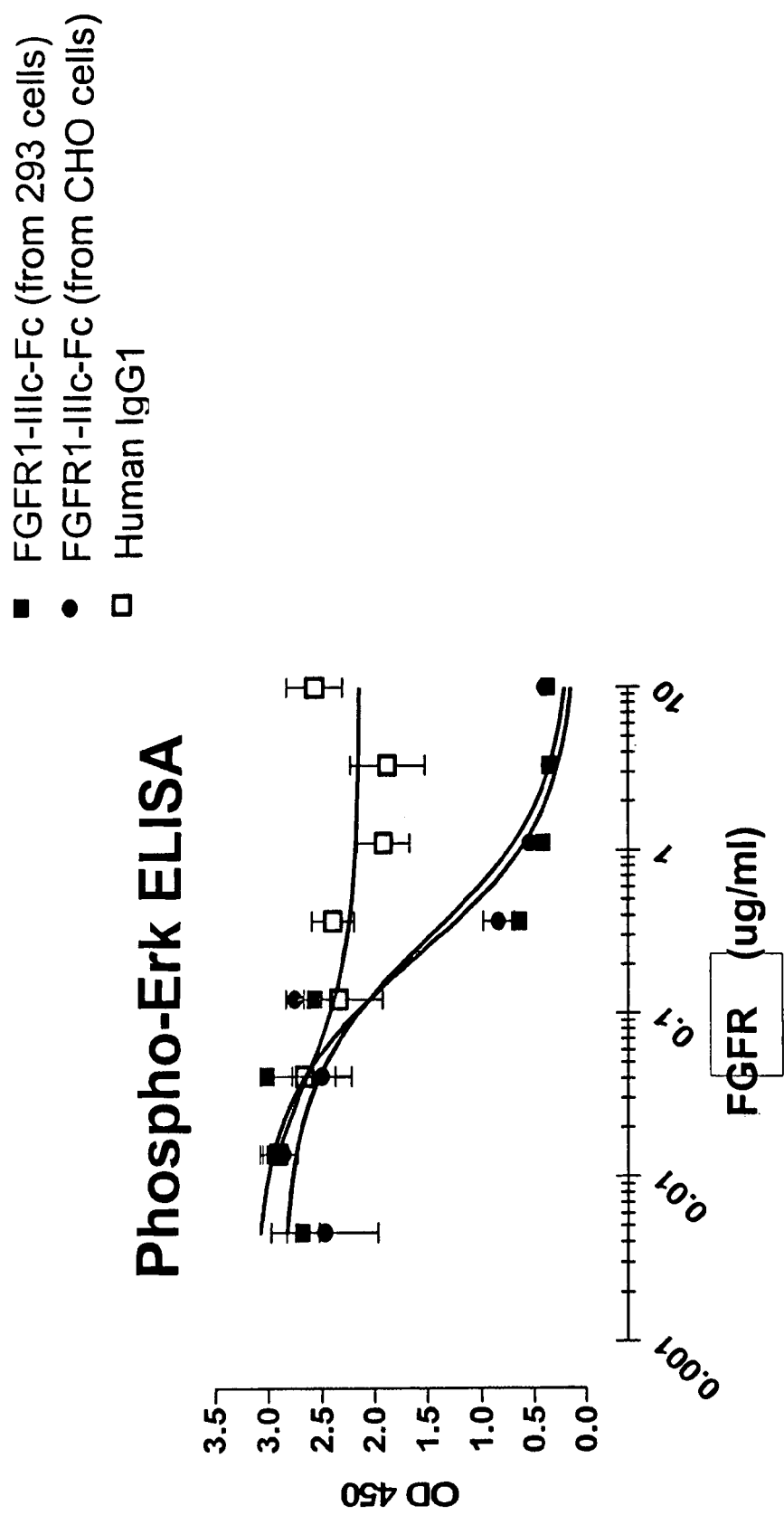
FIG. 13 shows a competition phospho-Erk ELISA assay, measuring changes in $OD_{450}$ induced by increasing concentrations (ug/ml) of parental FGFR1-IIIc-Fc made by 293 cells or by CHO cells. Both parental constructs inhibited FGF-2 activated Erk phosphorylation, while human IgG was unable to do so.

FIG. 13 shows that Erk phosphorylation, as determined by ELISA, was similarly inhibited by FGFR1-IIIc-Fc made from either 293-6E or CHO cells. At the lower doses, FGFR1-IIIc-Fc blunted Erk activation and at higher doses, prevented activation by FGF-2. In the presence of 100 ng/ml FGF-2, the $EC_{50}$ values of the 293 cells-derived and the CHO cells-derived FGFR1-IIIc-Fc were 0.23 ug/ml and 0.29 ug/ml, respectively. Human IgG1 did not inhibit Erk phosphorylation activated with FGF-2.

Figure 14:
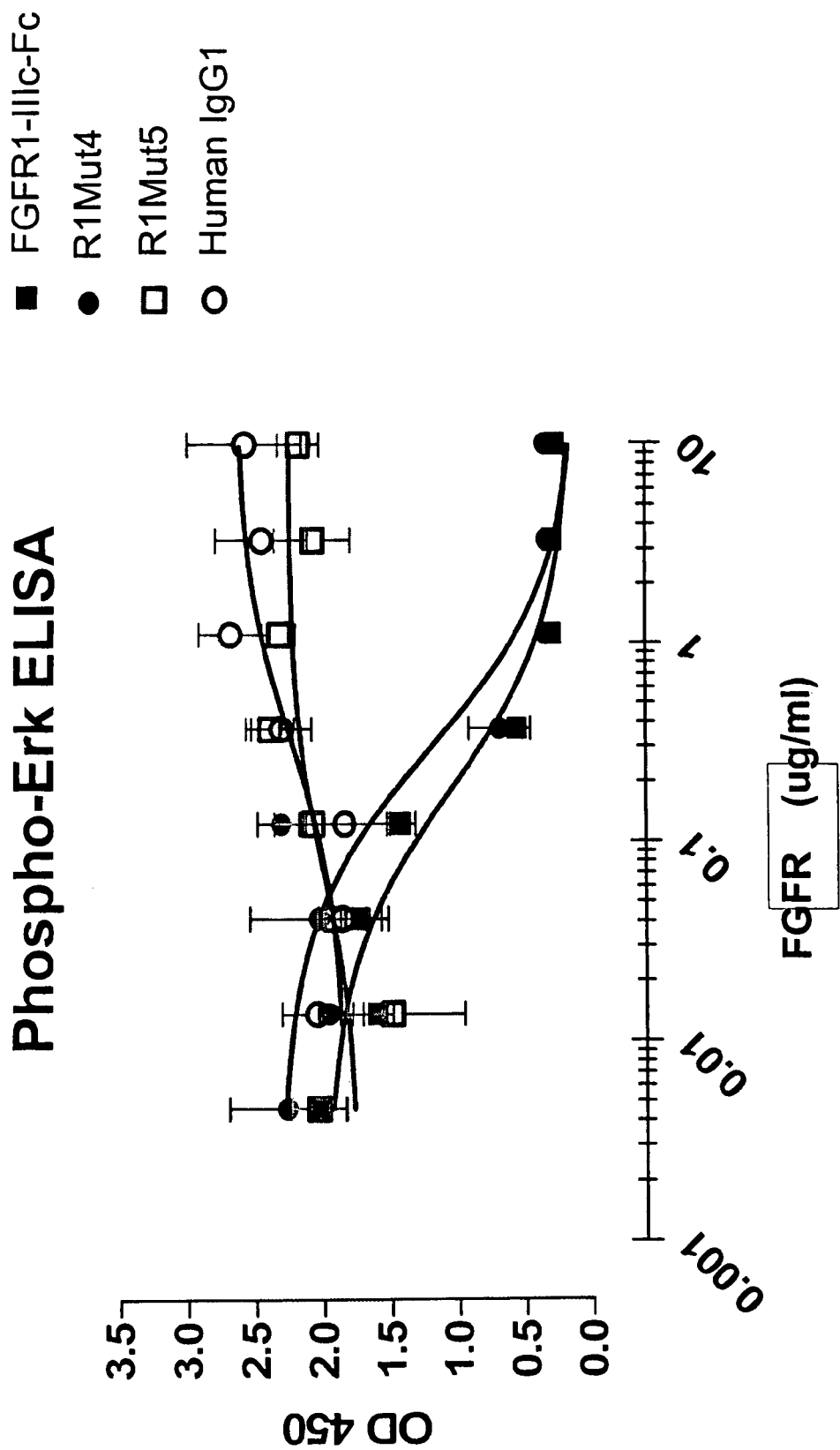
FIG. 14 shows a competition phospho-Erk ELISA assay, measuring changes in $OD_{450}$ induced by increasing concentrations (ug/ml) of parental FGFR1-IIIc-Fc, R1Mut4, and R1Mut5. Parental FGFR1-IIIc-Fc and R1Mut4, but not R1Mut5 or human IgG, inhibited FGF-2 activated Erk phosphorylation.

FGFR1-IIIc-Fc and R1Mut4 fusion proteins produced by 293-6E cells inhibited Erk phosphorylation with approximately the same potency, in contrast to R1Mut5, which did not inhibit Erk phosphorylation. In the presence of 0.10 ug/ml FGF-2, the $EC_{50}$ of FGFR1-IIIc-Fc was 0.18 ug/ml and the $EC_{50}$ of R1Mut4 was 0.29 ug/ml. At low doses, both FGFR1-IIIc-Fc and R1Mut4 blunted Erk activation; and at high doses, both prevented activation. Results are shown in FIG. 14.

EXAMPLE 13

FGFR1-IIIc-Fc Decreased Cancer Cell Viability and Proliferation

FGFR-Fc fusion proteins of the invention decreased the viability and/or proliferation of cancer cells in culture, as measured with a CellTiter-Glo™ Luminescent Cell Viability Assay according to the manufacturer's instructions (Promega; Madison, Wis.). In this assay, luminescence quantitatively correlates with the number of viable cells.

Figure 15:
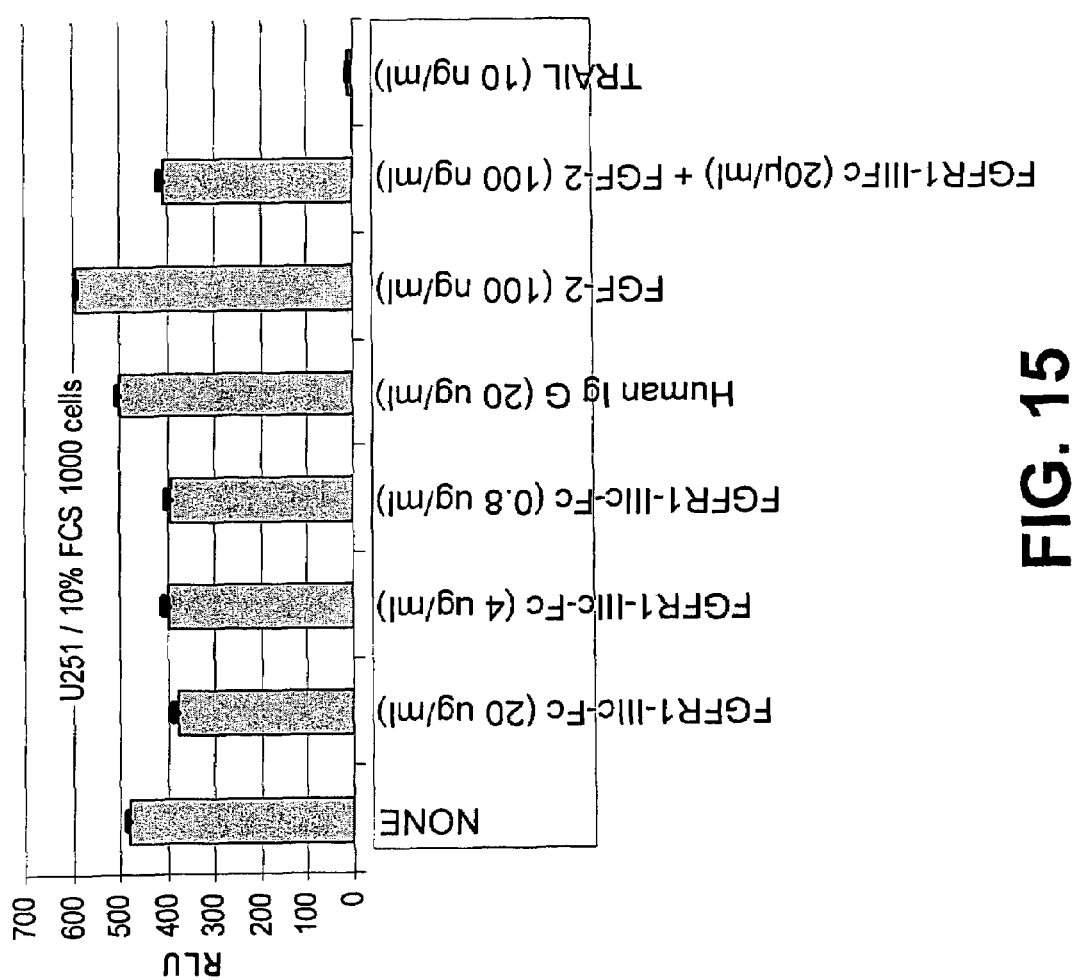
FIG. 15 shows a CellTiterGlo™ viability assay demonstrating the dose-dependent inhibitory effect of FGFR1-IIIc-Fc at concentrations of 20 ug/ml, 4.0 ug/ml, and 0.8 ug/ml on the viability and proliferation of U251 malignant glioblastoma cells plated at a concentration of 1000 cells per well in 10% FCS. Human IgG had no effect. The positive control, TRAIL, induced maximum inhibition.
Figure 16:
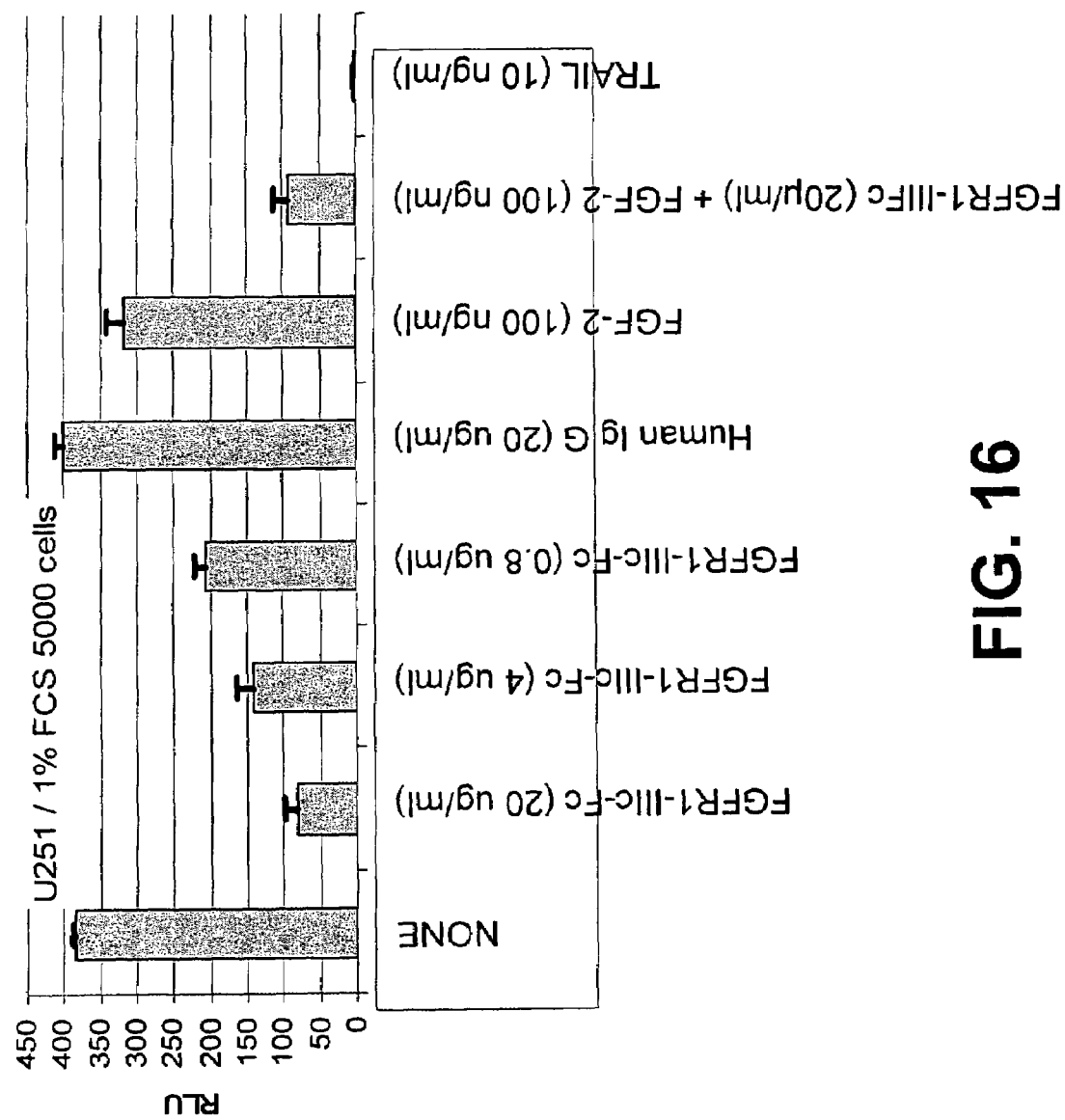
FIG. 16 shows a CellTiterGlo™ viability assay demonstrating the dose-dependent inhibitory effect of FGFR1-IIIc-Fc at concentrations of 20 ug/ml, 4.0 ug/ml, and 0.8 ug/ml on the viability and proliferation of U251 malignant glioblastoma cells plated at a concentration of 5000 cells per well in 1.0% FCS. Human IgG had no effect. The positive control, TRAIL, induced maximum inhibition.
Figure 17:
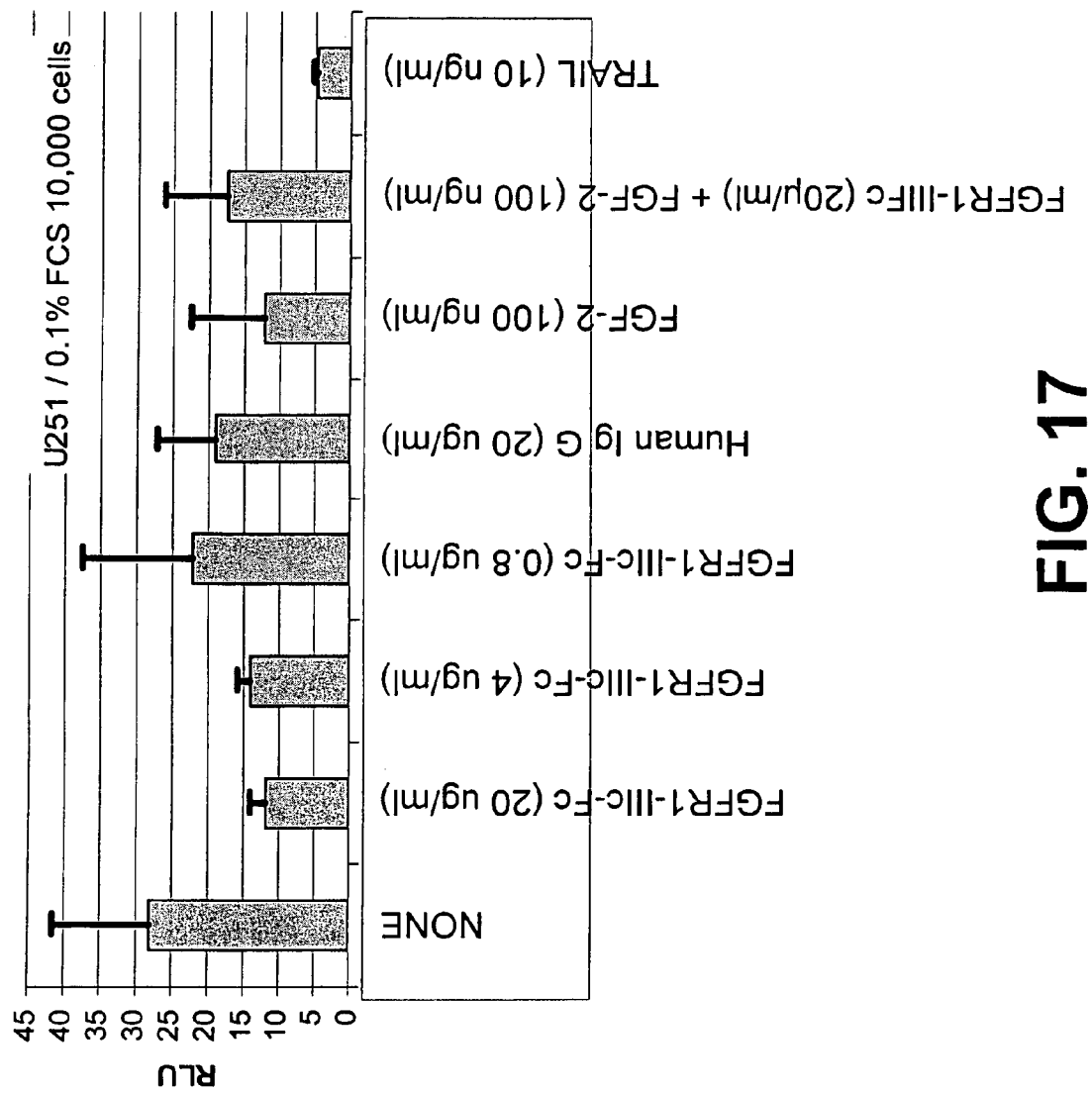
FIG. 17 shows a CellTiterGlo™ viability assay demonstrating the dose-dependent inhibitory effect of FGFR1-IIIc-Fc at concentrations of 20 ug/ml, 4.0 ug/ml, and 0.8 ug/ml on the viability and proliferation of U251 malignant glioblastoma cells plated at a concentration of 10,000 cells per well in 0.1% FCS. Human IgG had no effect. The positive control, TRAIL, induced maximum inhibition.

The effects of FGFR1-IIIc-Fc on U251 malignant glioblastoma brain cancer cells obtained from the American Type Culture Collection (ATCC) (Manassas, Va.) are shown in FIGS. 15-17. The effect of FGFR1-IIIc-Fc on cell viability and proliferation was dependent on the concentration of FGFR1-IIIc-Fc and on the growth conditions of the cells. The negative control human IgG (20 ug/ml) had no effect. The positive control, TRAIL, decreased viability and proliferation. FGF-2 (100 ug/ml) stimulated proliferation and differentiation. At the lower cell concentrations tested, FGF-2 did not blunt the inhibition induced by 20 μg/ml FGFR1-IIIc-Fc.

U251 cells were grown in DMEM with 4 mM L-glutamine adjusted to contain 1.5 grams per liter (g/L) sodium bicarbonate and 4.5 g/L glucose, 10% heat-inactivated FCS with 100 units/ml penicillin and 100 ug/ml streptomycin (pen-strep, Invitrogen; Carlsbad, Calif.) in T-150 flasks until they reached 70% to 90% confluency. The cells were treated with 10 ml per flask of 0.25% trypsin solution in Hanks' Balanced Salt solution (Invitrogen; Carlsbad, Calif.) at room temperature for 3 min at 37° C. and the trypsin-cell suspension mixed with 40 ml of ice-cold 0.1% FCS in DMEM. The cells were pelleted at 900×g for 5 min at room temperature. This wash step was repeated with 50 ml of ice-cold 0.1% FCS in DMEM and the cells resuspended in 5 ml of ice-cold 0.1% FCS in DMEM.

The resuspended U251 cells were plated in a volume of 150 ul per well in 96-well flat-bottom tissue-culture grade plastic plates (Nunc; Rochester, N.Y.) in the presence of 20 ug/ml of porcine intestinal mucosa heparin (Sigma; St. Louis, Mo.). The cells were plated at three culture conditions (1) a concentration of 1000 cells per well in the presence of 10% FCS in DMEM with pen-strep; (2) a concentration of 5000 cells per well in the presence of 1.0% FCS in DMEM with pen-strep; (3) a concentration of 10,000 cells per well in the presence of 0.1% FCS in DMEM with pen-strep. The cells were treated with FGFR1-IIIc-Fc protein or a control protein in four replicate wells per protein and incubated for five days in a humidified incubator at 37° C. with 5% $CO_2$. The FGFR1-IIIc-Fc protein was made from 293-6E cells and substantially purified as described in Examples 2 and 7. The cells were treated with FGFR1-IIIc-Fc at a concentration of 20 ug/ml, 4 ug/ml, or 0.8 ug/ml. Control proteins included 20 ug/ml purified human IgG dialyzed against PBS to remove preservative and then filter-sterilized (Caltag; Burlingame, Calif.) as a negative control, 100 ng/ml FGF-2 (R&D Systems; Minneapolis, Minn.), used either alone or in combination with 20 ug/ml FGFR1-IIIc-Fc as a positive control; and 10 ng/ml TRAIL (APO2 ligand/tumor necrosis factor-related apoptosis-inducing ligand) (R&D Systems; Minneapolis, Minn.), used as a positive control.

Cell viability was then determined using the CellTiter-Glo™ Luminescent Cell Viability Assay Kit (Promega; Madison, Wis.), according to the manufacturer's instructions. Briefly, 100 ul/well of reconstituted CellTiter-Glo™ reagent was added to the cells and incubated for 10 min in the dark. The well contents were mixed by pipetting and 100 ul from each well were transferred to opaque, white 96-well plates (Corning; Acton, Mass.). The luminescent output from each well was read using a 0.6 second per well recording time and the average relative luminescence units (RLU of the four replicates were plotted along with their standard deviations.

As shown in FIG. 15, FGFR1-IIIc-Fc at each of the three concentrations tested reduced the viability and proliferation of cultured U251 malignant glioblastoma cells plated at a concentration of 1000 cells per well in 10% FCS. Untreated cells showed an RLU of about 480. Cells treated with 20 ug/ml, 4 ug/ml, and 0.8 ug/ml FGFR1-IIIc-Fc showed an RLU of about 380, 400, and 400, respectively. Human IgG did not inhibit viability and proliferation, showing an RLU of about 500. FGF-2 alone enhanced viability and proliferation, showing an RLU of about 600. The combination of FGF-2 and 20 ug/ml FGFR1-IIIc-Fc reduced cell viability and proliferation, showing an RLU of about 400. Treatment with TRAIL resulted in almost complete inhibition, with an RLU of about 10.

As shown in FIG. 16, FGFR1-IIIc-Fc at each of the three concentrations tested reduced the viability and proliferation of cultured U251 malignant glioblastoma cells plated at a concentration of 5000 cells per well in 1.0% FCS. Untreated cells showed a RLU of about 360. Cells treated with 20 ug/ml, 4 ug/ml, and 0.8 ug/ml FGFR1-IIIc-Fc showed an RLU of about 60, 140, and 200, respectively. Human IgG did not inhibit viability and proliferation, showing an RLU of about 400. FGF-2 alone showed an RLU of about 320. The combination of FGF-2 and 20 ug/ml FGFR1-IIIc-Fc reduced cell viability and proliferation, showing an RLU of about 90. Treatment with TRAIL resulted in almost complete inhibition.

As shown in FIG. 17, FGFR1-IIIc-Fc reduced the viability and proliferation of cultured U251 malignant glioblastoma cells plated at a concentration of 10,000 cells per well in 0.1% FCS. These growth conditions generated more variability between wells, but FIG. 17 demonstrates that FGFR1-IIIc-Fc inhibited the viability and proliferation of U251 cells in a fashion similar to that described in FIG. 15 and FIG. 16.

The effect of FGFR1-IIIc-Fc on the viability and proliferation of cancer cells from cancer cell lines representing various solid tumor types obtained from ATCC (Manassas, Va.) or NCI (Bethesda, Md.) was tested using the CellTiter-Glo™ Luminescent Cell Viability Assay. The cells were grown to about 70% to 90% confluency in T-150 flasks using the recommended growth media for each cell line. The cells were harvested and treated in a manner similar to that described above for U251 cells. The cells were plated at a density of 1000 cells per well in the presence of 10% FCS in DMEM, 5000 cells per well in the presence of 1.0% FCS in DMEM, or 10,000 cells per well in the presence of 0.1% FCS in DMEM; with 20 ug/ml FGFR1-IIIc-Fc as the test agent or 20 ug/ml human IgG as the negative control.

The cancer cell lines tested included MDA-MB-435 (breast), MCF7 (breast), MDA-MB-231 (breast), T47D (breast), A549 (lung), NCI-H522 (lung), NCI-H460 (lung), NCI-H23 (lung), NCI-H226 (lung), U118 (brain), U87114 (brain), U251 (brain), SF268 (brain), WT11 (brain), DU145 (prostate), PC-3 (prostate), COLO 205 (colon), Caki-1 (kidney), SK-MEL-2 (skin) and SK-OV-3 (ovary). The results are shown in FIG. 18. Of the 20 cancer cell lines tested, eight were susceptible to inhibition by FGFR1-IIIc-Fc under one or more of the growth conditions tested. The eight susceptible cell lines were A549 (lung), NCI-H522 (lung), NCI-H226 (lung), U118 (brain), U251 (brain), SF268 (brain), WT11 (brain), and Caki-1 (kidney).

Figure 19:
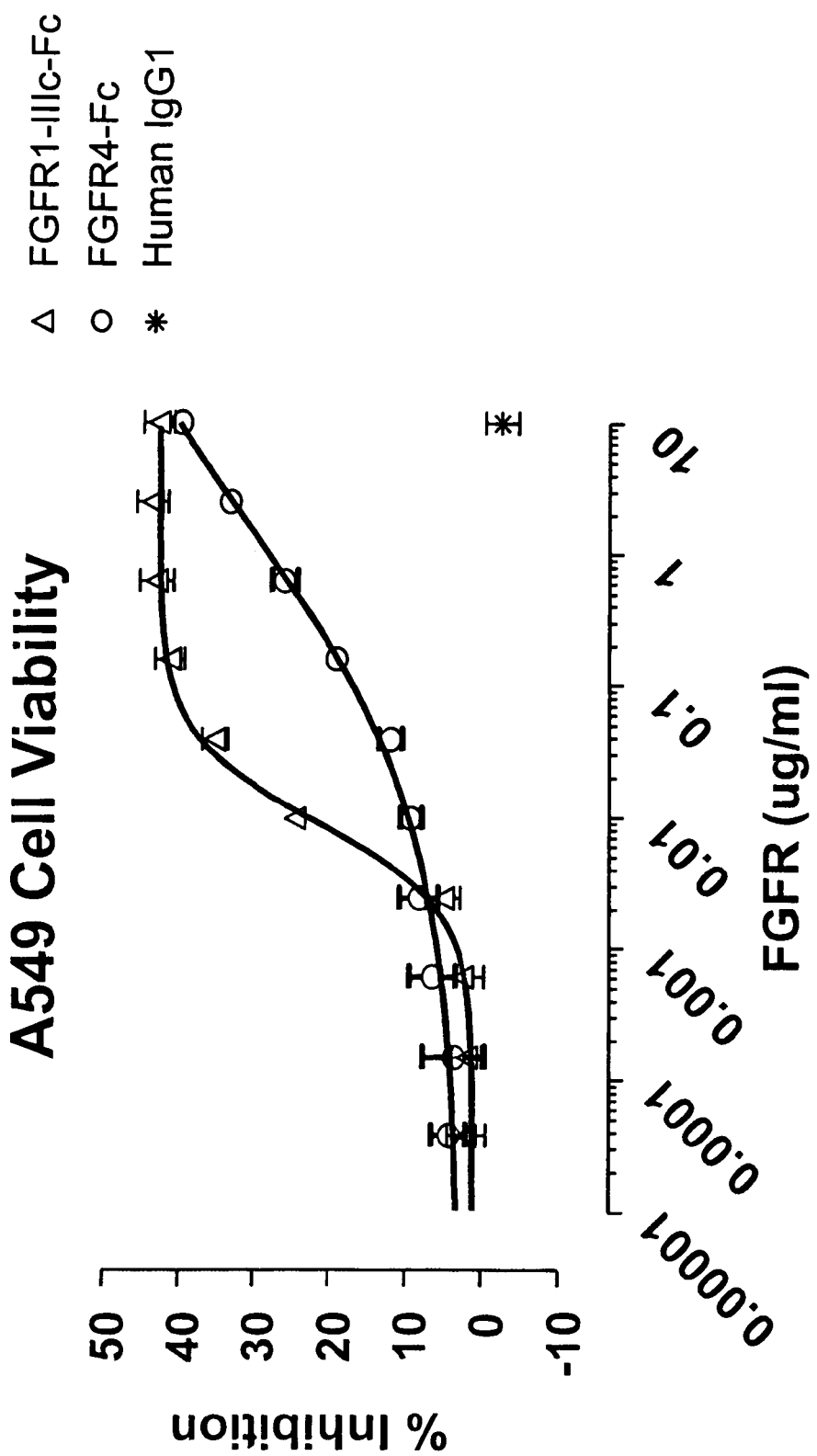
FIG. 19 shows a CellTiterGlo™ viability assay demonstrating the dose-dependent inhibitory effect of both FGFR1-IIIc-Fc and FGFR4-Fc on the viability and proliferation of A549 lung carcinoma cells.

Both FGFR1-IIIc-Fc and FGFR4-Fc inhibited the viability and proliferation of A549 lung carcinoma cells, as measured by the CellTiter-Glo™ Luminescent Cell Viability Assay. The FGFR1-IIIc-Fc and FGFR4-Fc proteins tested were produced in 293-6E cells via transient transfection and purified as described in Examples 2 and 7. The effect of FGFR1-IIIc-Fc and FGFR4-Fc on A549 cells was tested using a protocol similar to that described above for U251 cells. The A549 cells were seeded in four replicate wells at a density of 25,000 cells per well in a volume of 150 ul in flat-bottom 96-well plates in the presence of 20 ug/ml porcine intestinal mucosa heparin (Sigma; Saint Louis, Mo.) in 0.1% FCS DMEM with pen-strep. The A549 cells were cultured in the presence of concentrations of FGFR1-IIIc-Fc protein or FGFR4-Fc protein ranging from about 0.0000095 ug/ml to about 10 ug/ml in four-fold serial dilutions for five days at 37° C. in 5% $CO_2$. Human IgG (10 ug/ml) was used as a negative control. As shown in FIG. 19, cell viability and proliferation were expressed as percent inhibition (average RLU for untreated—average RLU for sample)/(average RLU for untreated) times 100. The error bars show the % Error (standard deviation of sample/average sample RLU) times 100.

At the higher concentrations tested, FGFR1-IIIc-Fc inhibited the viability and proliferation of A549 cells up to about 40%, as compared to the IgG control. The $IC_{50}$ of FGFR1-IIIc-Fc was about 9.4 ng/ml, equivalent to 0.11 nanomolar (nM). At the highest concentration tested, FGFR4-Fc also inhibited the viability and proliferation of A549 cells up to about 40%, as compared to the IgG control. The $IC_{50}$ of FGFR4-Fc was about 100 ng/ml, equivalent to 1.2 nM; this is higher than that observed for FGFR1-IIIc-Fc, reflecting a greater potency of FGFR1-IIIc-Fc than FGFR4-Fc in inhibiting A549 cell viability and proliferation.

EXAMPLE 14

FGFR-Fc Fusion Proteins Decreased Cancer Cell Viability and Proliferation

FGFR1-IIIb-Fc, FGFR1-IIIc-Fc, FGFR2-IIIb-Fc, FGFR2-IIIc-Fc, FGFR3-IIIb-Fc, FGFR3-IIIc-Fc, and FGFR4-Fc were tested for the ability to inhibit the viability and/or proliferation of six different cancer cell lines. The seven fusion proteins tested in this assay were obtained from a commercial source (R&D Systems). The cancer cell lines included A549 (lung), U118 (brain), U251 (brain), SF268 (brain), T47D (breast) and Caki-1 (kidney).

The results obtained from the assays described in Example 13 provided the basis for determining the number of cancer cells plated per well and the concentration of FCS in their media. For instance, the A549 lung carcinoma cells were plated at 25,000 cells per well in 150 ul of DMEM with 0.1% FCS and pen-strep in a 96-well format. They were treated with two-fold serial dilutions of FGFR1-IIIc-Fc, FGFR2-IIIc-Fc, FGFR3-IIIc-Fc, or FGFR4-Fc ranging from about 0.078125 ug/ml to about 5.0 ug/ml. Human IgG was used as a positive control, as described in Example 11. Each fusion protein treatment was performed in triplicate wells and each data point represents an average of three wells. After five days of treatment, the cell viability of A549 cells was assayed with the CellTiter-Glo™ Luminescent Cell Viability Assay as described above. The results are shown in FIG. 20 and indicated that the FGFR-Fc fusion protein inhibition of A549 cells was dose-dependent, reaching up to about 42% at the highest concentrations tested (5 ug/ml). The potencies of the fusion proteins were ranked as FGFR1-IIIc-Fc=FGFR2-IIIc-Fc>FGFR3-IIIc-Fc=FGFR1-IIIb-Fc>FGFR2-IIIb-Fc=FGFR4-Fc>FGFR3-IIIb-Fc>human IgG.

Figure 20A:
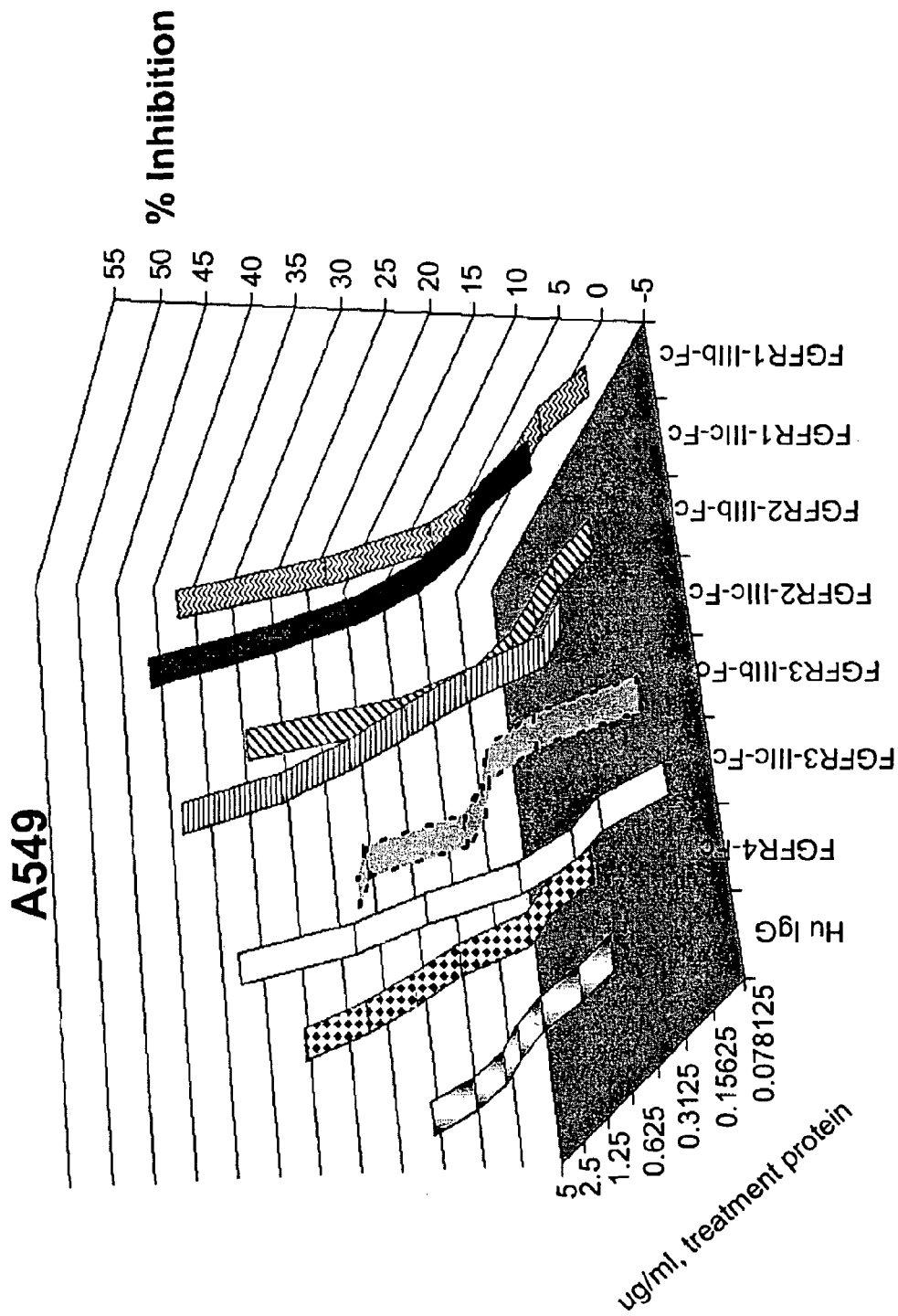
FIG. 20 compares the inhibitory effect of FGFR1-IIIb-Fc, FGFR1-IIIc-Fc, FGFR2-IIIb-Fc, FGFR2-IIIc-Fc, FGFR3-IIIb-Fc, FGFR3-IIIc-Fc, and FGFR4-Fc on the viability and proliferation of tumor cells from tumor cell lines, showing increasing inhibition (% inhibition) with increased concentration of the fusion proteins (treatment protein (ug/ml)). Data is shown for A549 cells (FIG. 20A), U118 cells (FIG. 20B), U251 cells (FIG. 20C), SF268 cells (FIG. 20D), T47D cells (FIG. 20E), and Caki-1 cells (FIG. 20F).
FIG. 20G shows the concentration-dependent inhibitory effect of parental FGFR1-IIIc and R1Mut4, but not R1Mut5, on the viability and proliferation of A549 cells and U251 cells.
Figure 20B:
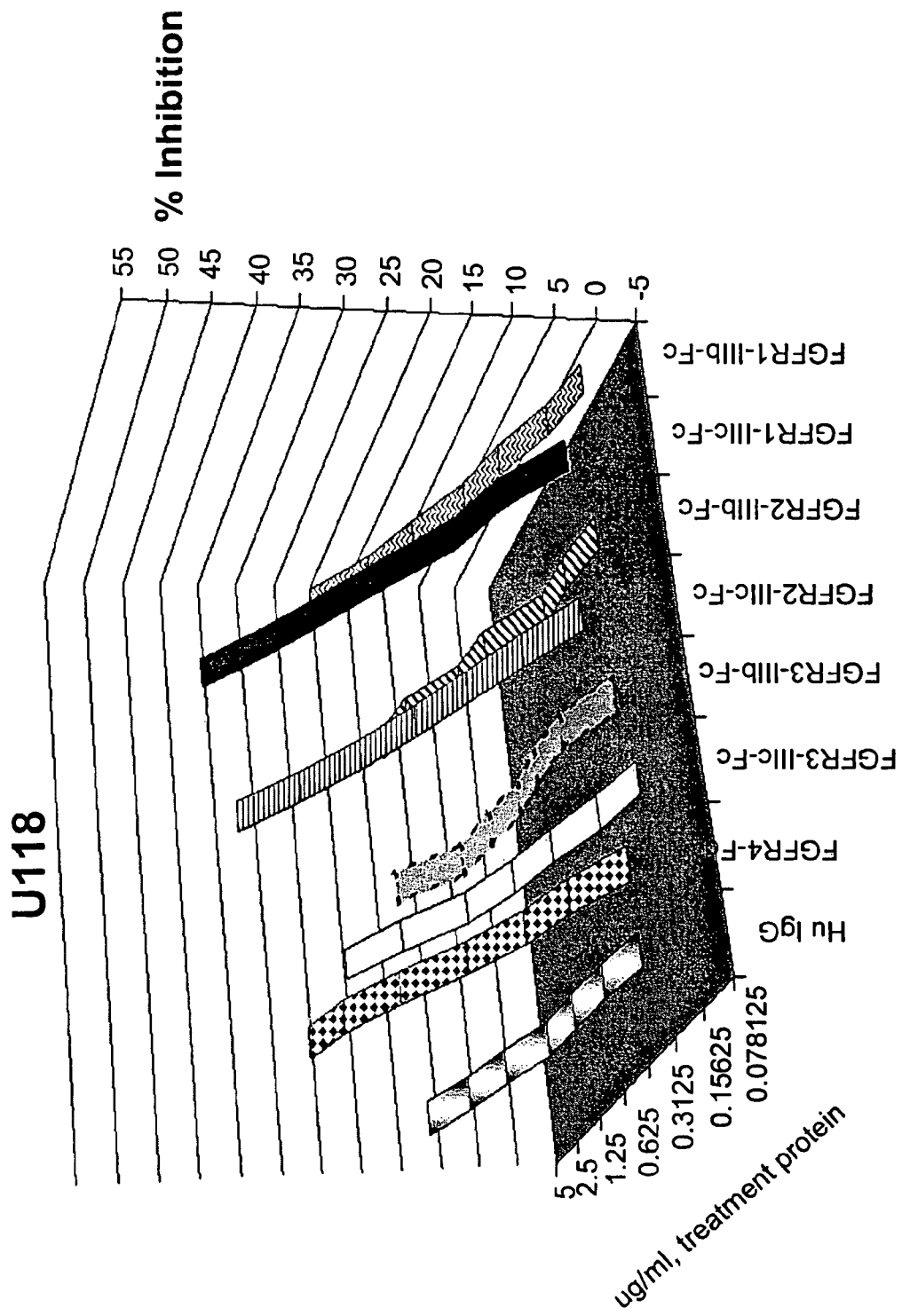
Figure 20C:
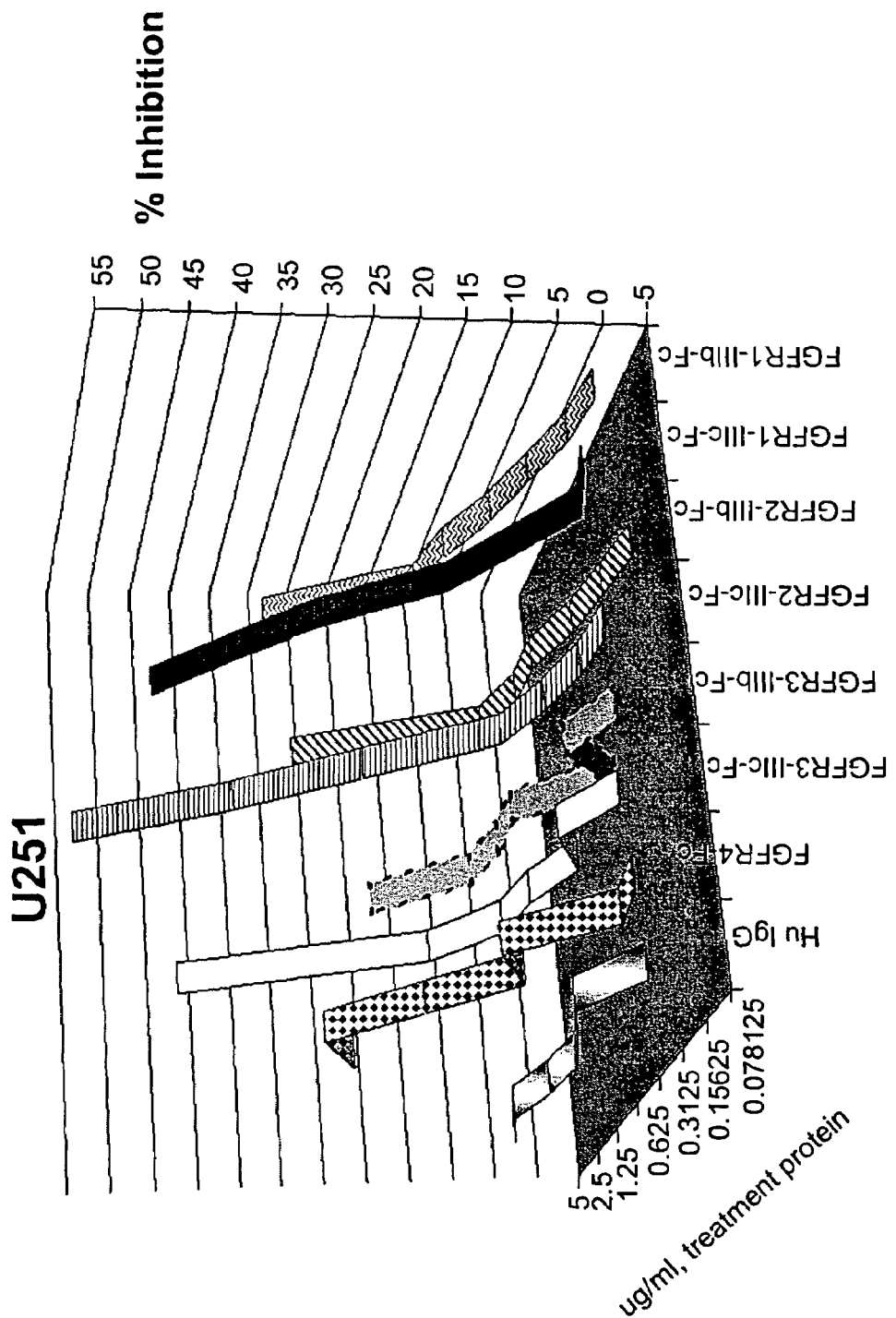
Figure 20D:
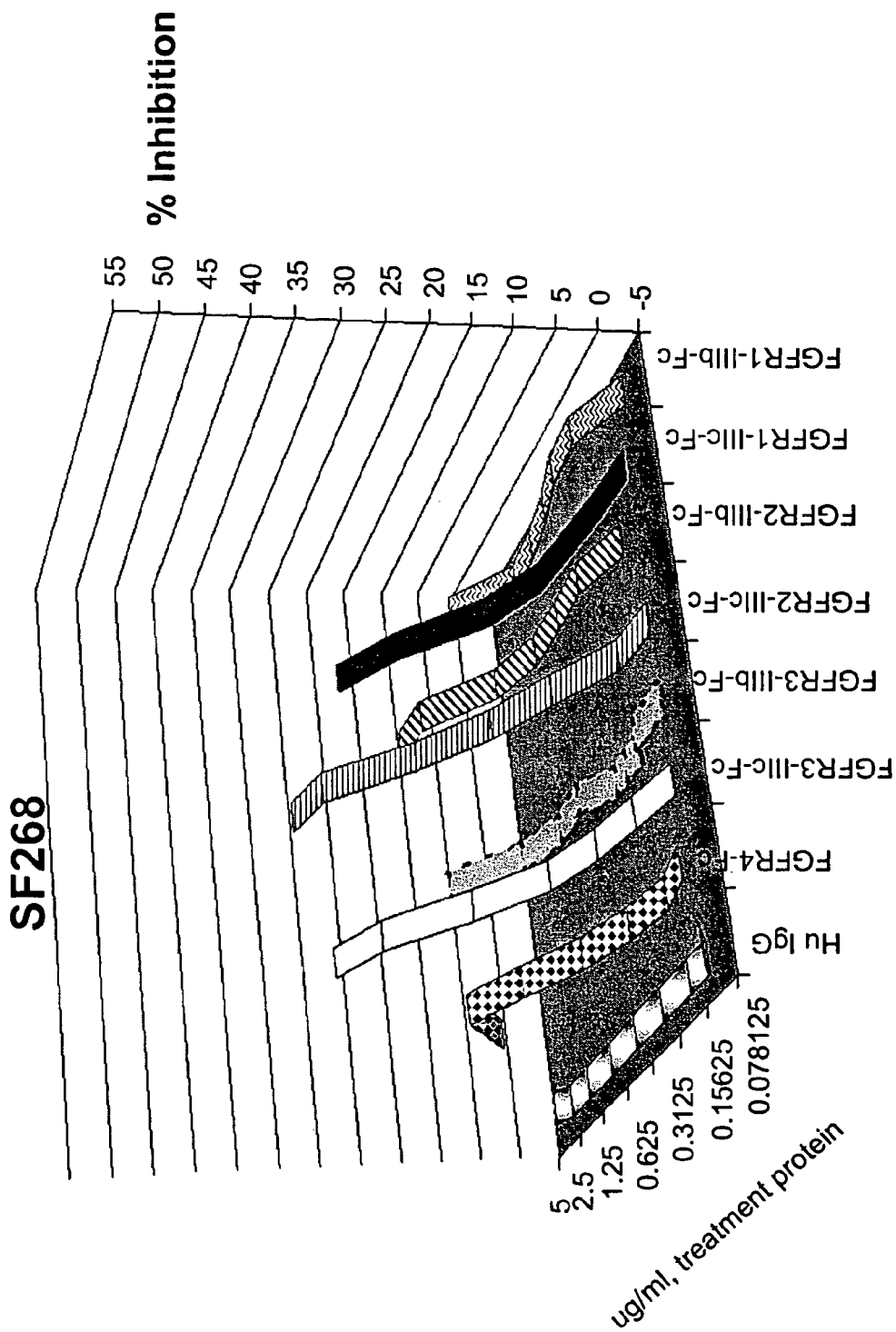
Figure 20E:
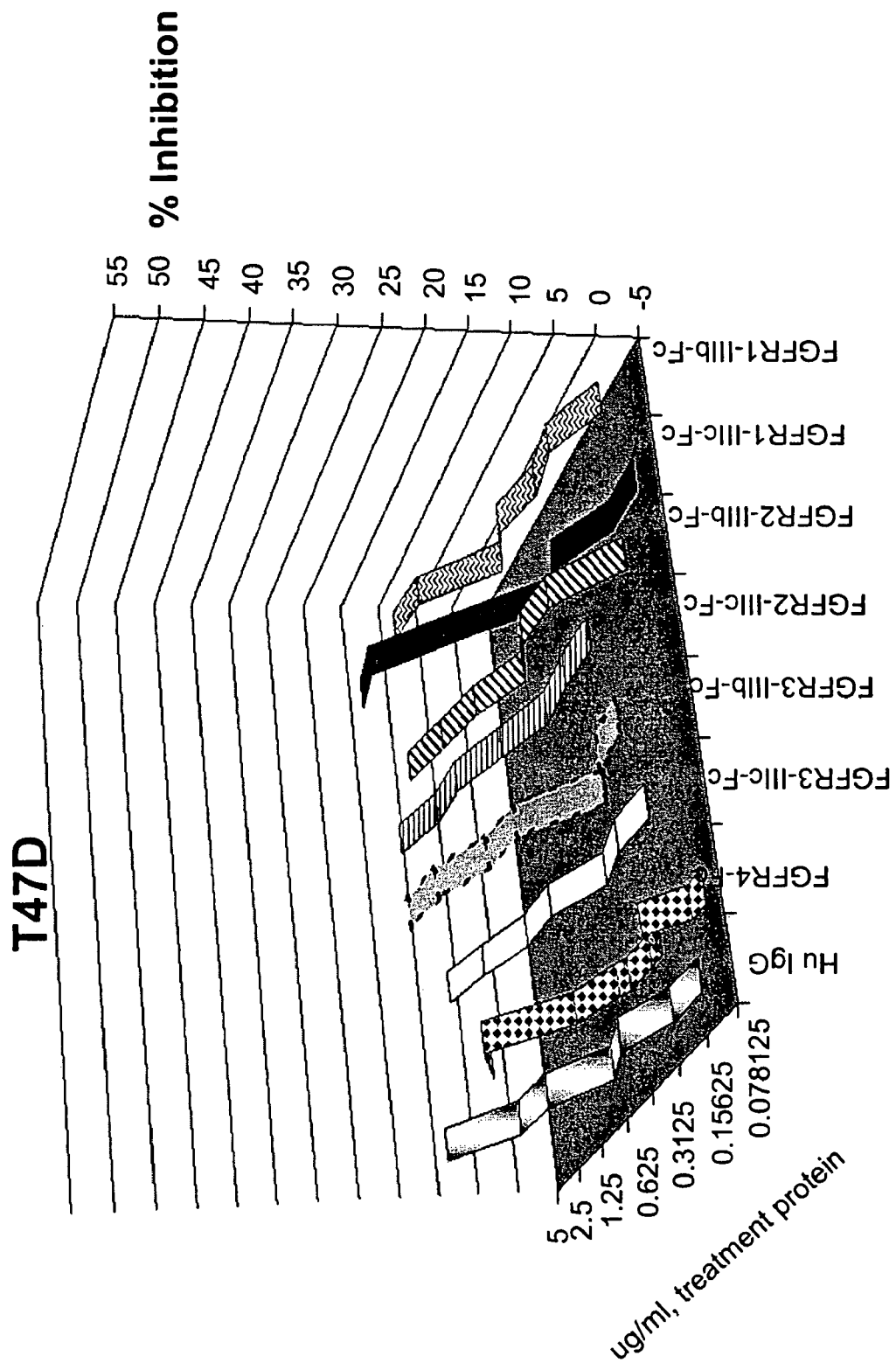
Figure 20F:
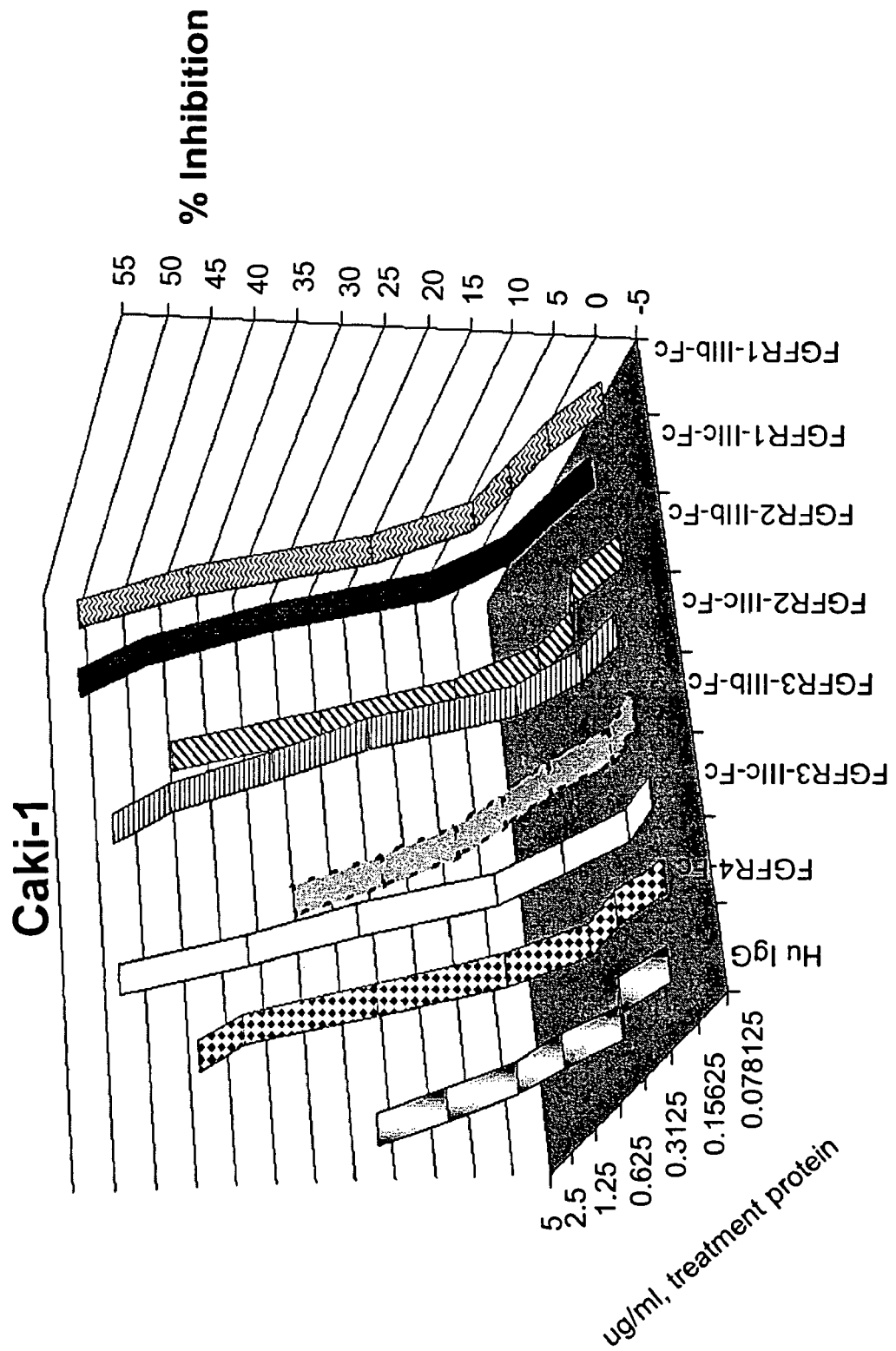

Similar experiments testing the effects of FGFR-Fc fusion proteins on viability and proliferation were performed with on the cancer cell lines U118 (FIG. 20B), U251 (FIG. 20C), SF268 (FIG. 20D), T47D (FIG. 20E) and Caki-1 (FIG. 20F). The protocols were similar to those described above, including the use of human IgG as a negative control. All of the cancer cell lines tested were inhibited by one or more of the seven FGFR-Fc fusion proteins. The results are summarized in FIG. 21.

Figure 20G:
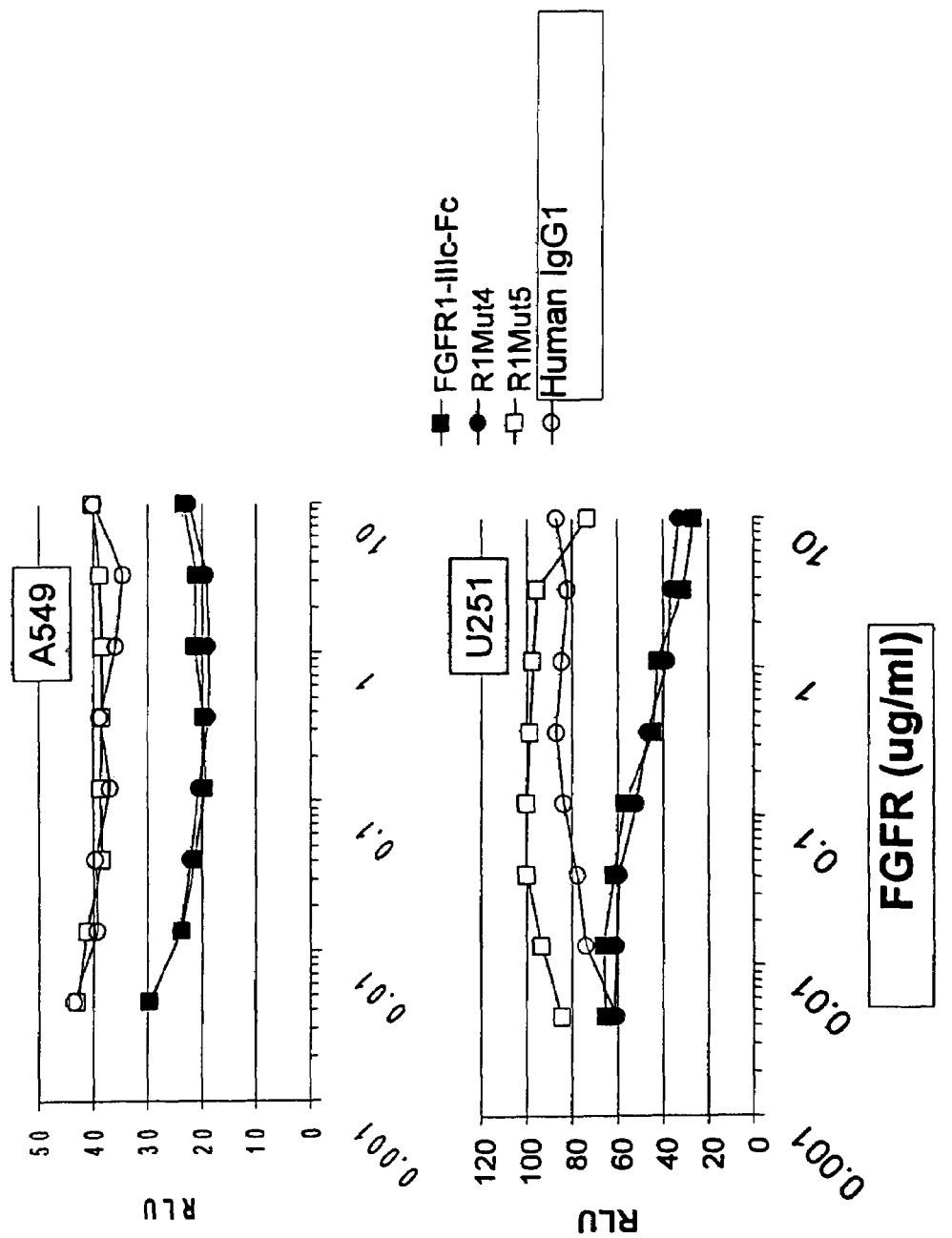

The FGFR1-IIIc-Fc mutant R1Mut4, but not R1Mut5, inhibited the viability and proliferation of the cancer cell lines A549 and U251 (FIG. 20G). The assay protocol was similar to that described above. The cells were treated with three-fold serial dilutions of FGFR1-IIIc-Fc, R1Mut4, R1Mut5, or human IgG at concentrations ranging from about 0.00457 ug/ml to about 10 ug/ml. FGFR1-IIIc-Fc, R1Mut4, and R1Mut5 were expressed in 293-6E cells using the pTT5 vector as described in Example 2 and purified as described in Example 7. Each fusion protein treatment was performed in triplicate wells. After five days of treatment, the viability of the A549 and U251 cells was assayed with CellTiter-Glo™ Luminescent Cell Viability Assay. Each data point represents an average of three wells. The results are shown in FIG. 20G. The A549 cells were inhibited to a similar extent (from approximately 40 RLU to 20 RLU) by both FGFR11-IIIc-Fc and R1Mut4 at all the doses tested. The U251 cells were also inhibited to a similar extent by FGFR1-IIIc-Fc and by R1Mut4. They displayed dose dependence at the concentrations tested, with no inhibition observed at the lowest dose and maximal inhibition (from approximately 100 RLU to 30 RLU) at the highest dose.

EXAMPLE 15

Sustained Expression of FGFR1-IIIc—Fc in Mice In Vivo

The effect of sustained expression of human FGFR1IIIc-Fc fusion protein in animal models, for example, animal tumor models, was tested using the hydrodynamic tail vein injection method to express FGFR1-IIIc-Fc in mice. Naked "mini-circle" vector cDNA encoding the FGFR1-IIIc-Fc fusion protein was injected into three-month old C57/B16 female mice (Charles River Laboratory; Hollister, Calif.). This "mini-circle" vector contained FGFR1 IIIc-Fc cDNA and was generated as described in Example 2. The animals were injected via their tail veins using the hydrodynamic tail vein injection method as reported in Liu, F. et al., *Gene Therapy* 6:1258-1266 (1999) and U.S. Pat. No. 6,627,616, at a DNA concentration of about 15 ug/ml in saline. About 2 ml of the DNA composition was injected in 5-8 seconds into each mouse. Three mice were injected with mini-circle DNA containing the FGFR1-IIIc-Fc cDNA and three mice were injected with saline as controls. Serum samples with a volume of about 50 ul were obtained from tail vein nicks on days 2, 9, 16, 24, 30, 37, and 44 post-injection. The concentration of the FGFR1-IIIc-Fc protein in the serum samples was analyzed by direct ELISA and the ligand binding activity of the FGFR1-IIIc-Fc in the mouse sera was analyzed by FGF-2 competition ELISA. Both ELISA methods are described in further detail below.

A direct sandwich ELISA to detect FGFR1-IIIc-Fc was developed and used to detect FGFR1-IIIc-Fc in the serum of the injected mice. Briefly, HI-BIND half-well plates (Corning; Acton, Mass.) were coated with anti-human FGFR1 antibody (QED Bioscience, San Diego, Calif.) diluted in PBS to a concentration of 3 ug/ml for 1 hr at room temperature or overnight at 4° C.; the wells were then blocked with blocking buffer (BLOTTO diluted to 3% in PBS) for 2-5 hr at room temperature. The plates were washed with PBS containing 0.05% Tween-20, and 50 ul of mouse serum from each of the test animals diluted in 0.6× BLOTTO was added, respectively, to each well and incubated for 2 hr at room temperature. The plates were then washed as before and incubated with 50 ul/well peroxidase-conjugated AffiPure goat anti-human Fc antibody (Jackson ImmunoResearch Laboratories; West Grove, Pa.) diluted 1:3000 in Blocking Buffer for 60 min at room temperature. The plates were washed as before, and the wells were incubated for 10 to 20 min with reconstituted OPD solution (Sigma; Saint Louis, Mo.) at room temperature and the absorbance at 450 nm determined.

Figure 22:
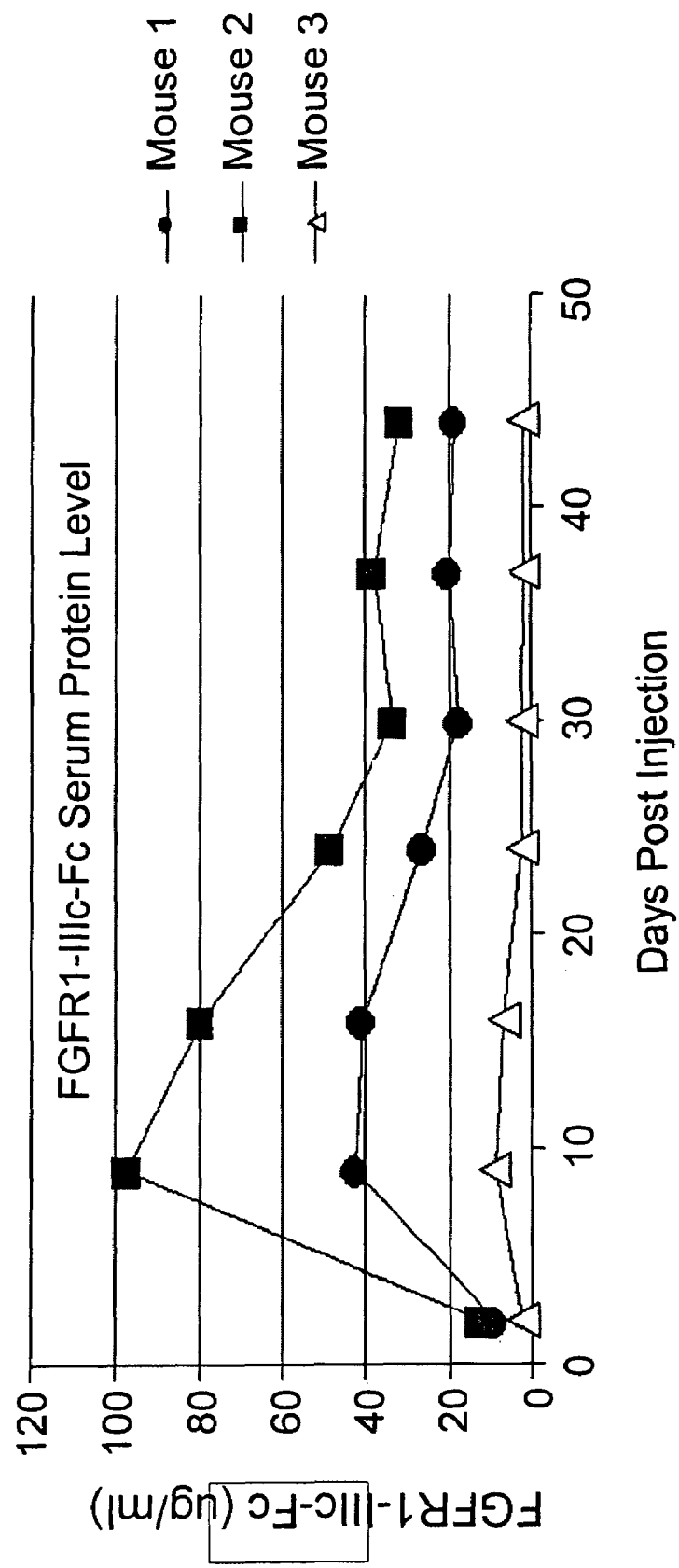
FIG. 22 shows the concentration of FGFR1-IIIc-Fc (ug/ml) in the sera of three mice injected with "mini-circle" vector cDNA encoding FGFR1-IIIc-Fc using the hydrodynamic tail vein injection method, as measured by direct ELISA assay and monitored for about 45 days post injection.

The results are shown in FIG. 22, and demonstrate the amount of FGFR1-IIIc-Fc fusion protein in the sera of each of the three injected mice in the days following injection of the cDNA encoding the fusion protein. The saline-injected mice showed no detectable levels of the fusion protein. Expression of FGFR1-IIIc-Fc in the serum remained high for at least 44 days post-transfection in the highest expresser mouse. FGFR1-IIIc-Fc was detected at about 10 ug/ml on day 2, about 100 ug/ml on day 9, about 80 ug/ml on day 16, about 50 ug/ml on day 24, and about 35 ug/ml on days 30 to 44 in this mouse. The other two mice injected with FGFR1-IIIc-Fc cDNA showed lower but detectable levels of the fusion protein. This study demonstrated that high and sustained expression of a human FGFR1-IIIc-Fc fusion protein could be achieved in mice after hydrodynamic tail vein injection of the cDNA and that these animals could be used to monitor treatment with this fusion protein.

An FGF-2 competition ELISA demonstrated that the FGFR1-IIIc-Fc fusion proteins expressed in these animals was functional. FGFR1-IIIc-Fc in the sera of the above-described cDNA-injected animals was capable of binding and sequestering a known ligand (for example, FGF-2). Briefly, serum from mice injected with FGFR1-IIIc-Fc cDNA was pre-treated with FGF-2 and the amount of free FGF-2 remaining in the pre-treated serum measured the ability of the expressed FGFR1-IIIc-Fc fusion protein to bind its ligand. The amount of free FGF-2 was measured by the ability of the pre-treated serum to bind to FGFR1-IIIc immobilized on an assay plate.

The serum from the injected mice was pre-treated with FGF-2. Briefly, the serum was diluted 1/500, 1/100, and 1/20 with 0.1× BLOTTO (diluted 1:10 in PBS) and added to 96-well U-bottom plates (Nunc; Rochester, N.Y.) with 200 ng/ml recombinant human FGF-2 (R&D Systems; Minneapolis, Minn.) in a volume of 50 ul for 30 min at 37° C. on a shaker, in the presence of 20 ug/ml heparin. The pre-treatment of the serum with FGF-2 sequestered the FGF-2 to the extent that the FGFR1-IIIc-Fc in the serum was able to bind its ligand FGF-2.

The pretreated serum was then incubated with assay plates coated with FGFR1-IIIc-Fc and the binding of free FGF-2 in the serum measured. A high level of free FGF-2 binding indicates that the circulating FGFR1-IIIc-Fc was not able to bind its ligand FGF-2 and a low level of free FGF-2 binding indicates that the FGFR1-IIIc-Fc expressed in the serum of the injected mice functioned to bind its ligand FGF-2.

HI-BIND half-wells (Corning; Acton, Mass.) were coated with FGFR1-IIIc-Fc of 293-6E host cell origin, at a concentration of 5 ug/ml in PBS in a volume of 25 ul per well for 1 hr at room temperature. The wells were blocked by adding 150 ul BLOTTO per well for 2 hr at room temperature. The coated half-well plates were then washed with PBS containing 0.05% Tween-20. The washed, coated, half-well plates were then incubated with 40 ul of the pre-treated serum for 30 min at 37° C. with shaking. The plates were washed as before with PBS containing 0.05% Tween-20. Then 2 ug/ml of biotinylated anti-FGF-2 polyclonal antibody (R&D Systems; Minneapolis, Minn.) in BLOTTO was added to each well and incubated for 30 min at 37° C. with shaking. The plates were washed again as before and bound antibody was detected with the ABC kit according to manufacturer's protocol. After the final wash with PBS containing 0.05% Tween-20, reconstituted OPD solution (Sigma; Saint Louis, Mo.) was added to each well and incubated for 10-20 min at room temperature and the absorbance of the wells at 450 nm determined.

Figure 23:
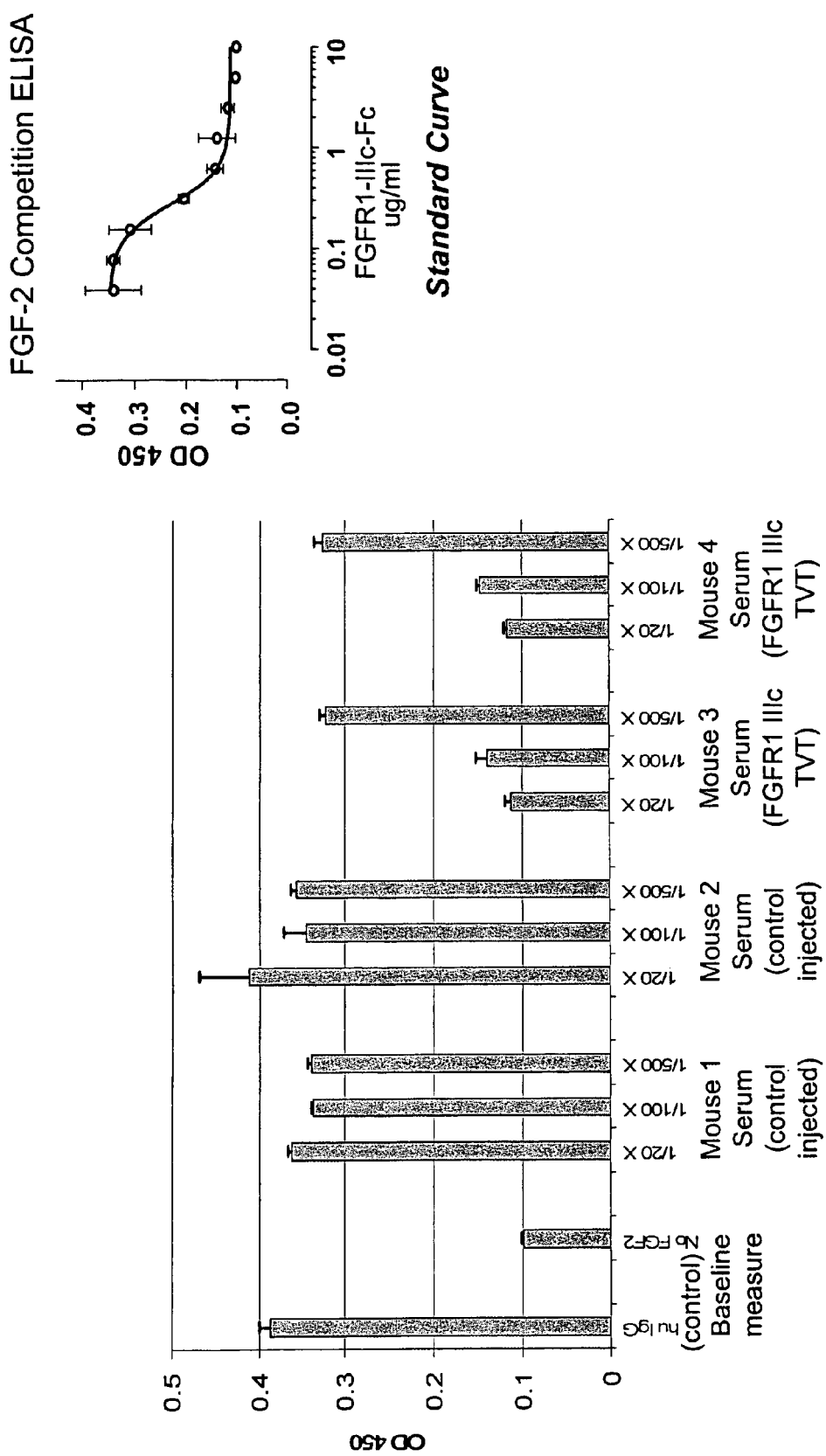
FIG. 23 shows the presence of functional, circulating FGFR1-IIIc-Fc in sera of mice injected with "mini-circle" vector cDNA encoding FGFR1-IIIc-Fc using the hydrodynamic tail vein injection method, compared to sera from control mice, as measured by a quantitative competition ELISA assay.

Results from two control mice injected with saline and two experimental mice injected with FGFR1-IIIc-Fc cDNA are shown in FIG. 23. Pretreated sera from control mouse 1 and mouse 2 showed little or no inhibition of FGF-2 binding to the FGFR1-Fc coated plates. Pretreated sera from mouse 3 and mouse 4, which expressed FGFR1-IIIc-Fc, sequestered FGF-2 in a dose-dependent manner, with the highest level of inhibition observed with the most concentrated sera (1/20 dilution). FIG. 23 also shows the standard curve of purified FGFR1-IIIc-Fc used to calculate the amount of circulating FGFR1-IIIc-Fc in the injected mice. The serum of experimental mouse 4 had the functional equivalent of 64 ug/ml of FGFR1-IIIc-Fc and the serum of experimental mouse 3 had the functional equivalent of 45 ug/ml serum FGFR1-IIIc-Fc.

EXAMPLE 16

In Vivo Expression of R1Mut4 Via Hydrodynamic Transfection

An experiment similar to that described in Example 15 was performed by hydrodynamic transfection of R1Mut4 cDNA into mice using the minicircle vector described in Example 2. Naked "mini-circle" vector cDNA encoding R1Mut4 was injected into four month old CB17 SCID mice (Charles River Laboratory; Hollister, Calif.). About 2 ml of the DNA was injected at a concentration of 20 μg/ml in 5 to 8 seconds into each of four control mice and four R1Mut4 experimental mice. Serum samples were collected at day 2 and day 7. The concentration of R1Mut4 in the serum samples was analyzed by direct ELISA (see Example 15), FGF-2 competition ELISA (see Example 15) and Western blot probing.

Figure 24:
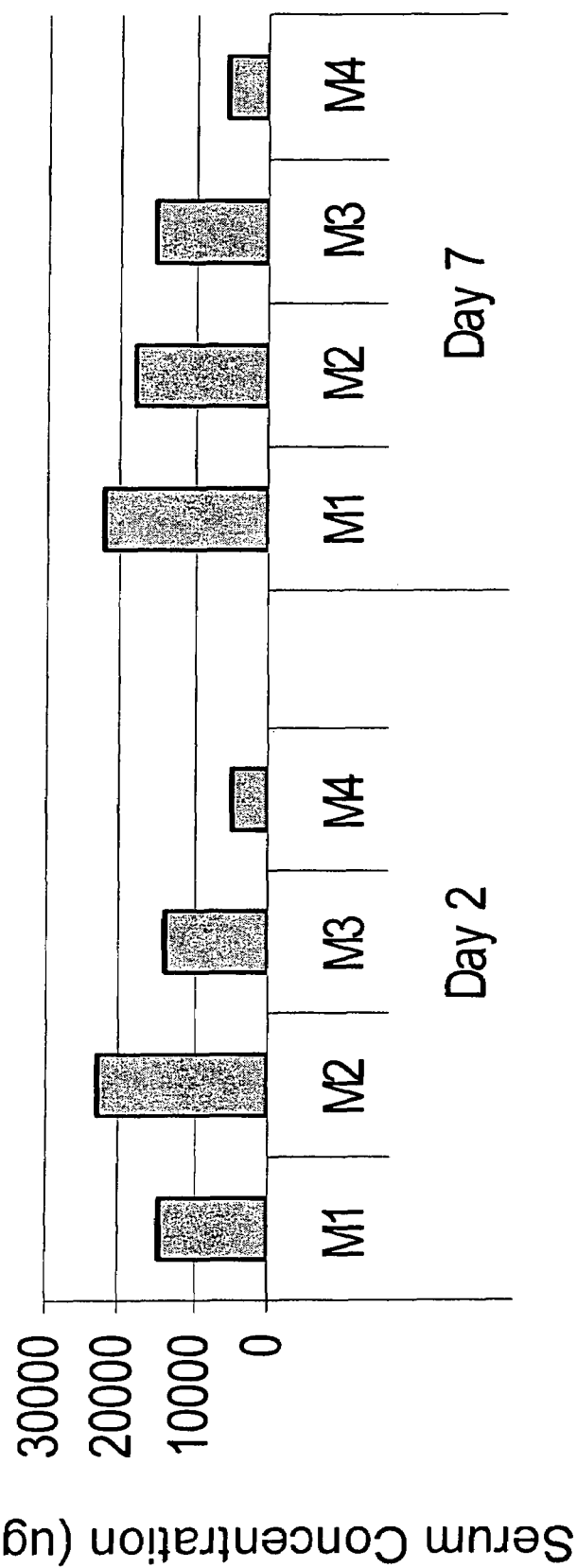
FIG. 24 shows of the serum concentration of functional, circulating R1Mut4 in the sera of each of four mice by mice injected with "mini-circle" vector cDNA encoding R1Mut4 using the hydrodynamic tail vein injection method, measured by a quantitative competition ELISA assay on days 2 and 7 post-injection.

Results from the direct ELISA test are shown in FIG. 24. M1-M4 represent sera from the four experimental R1Mut4-injected mice. Mouse 1 expressed about 14,000 ug/ml of R1Mut4 on day 2 and about 22,000 ug/ml of R1Mut4 on day 7; Mouse 2 expressed about 23,000 ug/ml of R1Mut4 on day 2 and about 17,000 ug/ml of R1Mut4 on day 7; Mouse 3 expressed about 14,000 ug/ml of R1Mut4 on day 2 and about 15,000 ug/ml of R1Mut4 on day 7; and Mouse 4 expressed about 5,000 ug/ml of R1Mut4 on day 2 and about 5,000 ug/ml of R1Mut4 on day 7. Thus, the concentration of R1Mut4 fusion protein in the mouse sera ranged from about 5 mg/ml to about 22.5 mg/ml, as measured by direct ELISA. Similar results were found using the FGF-2 competition ELISA and Western blot probing techniques. These results demonstrated a high and sustained systemic expression of R1Mut4 by animals injected using the hydrodynamic method, similar to that observed with FGFR1-IIIc-Fc.

EXAMPLE 17

In Vivo Comparison of FGFR1-IIIc-Fc Fusion Protein Produced by 293-6E and CHO-S Host Cells As shown in Example 5, FGFR1-IIIc-Fc expressed by CHO-S host cells showed superior in vitro stability compared to FGFR1-IIIc-Fc expressed by 293-6E host cells. To determine whether FGFR1-IIIc-Fc expressed by CHO-S host cells also showed a superior in vivo stability profile compared to FGFR1-IIIc-Fc expressed by 293-6E host cells, FGFR1-IIIc-Fc protein from both sources was injected into mice and compared over a 72 hour time course by Western blot.

C57BL6 mice were injected via tail vein with a dose of 3 mg/kilogram (kg) FGFR1-III-Fc protein purified either from CHO-5 or 293-6E host cells, as described in Examples 7 and 15. Blood was obtained retro-orbitally at 5 min, 30 min, 24 hr, 48 hr, and 72 hr post-injection and heparinized. Serum (100 μl) from each injected mouse and from an uninjected control mouse was separated on reducing 4-12% polyacrylamide gels via SDS-PAGE, transferred onto nitrocellulose membranes, and probed with HRP-conjugated anti-human Fc antibody (anti-human Fc HRP) (Jackson ImmunoResearch Laboratories, Inc.; West Grove, Pa.).

Figure 26:
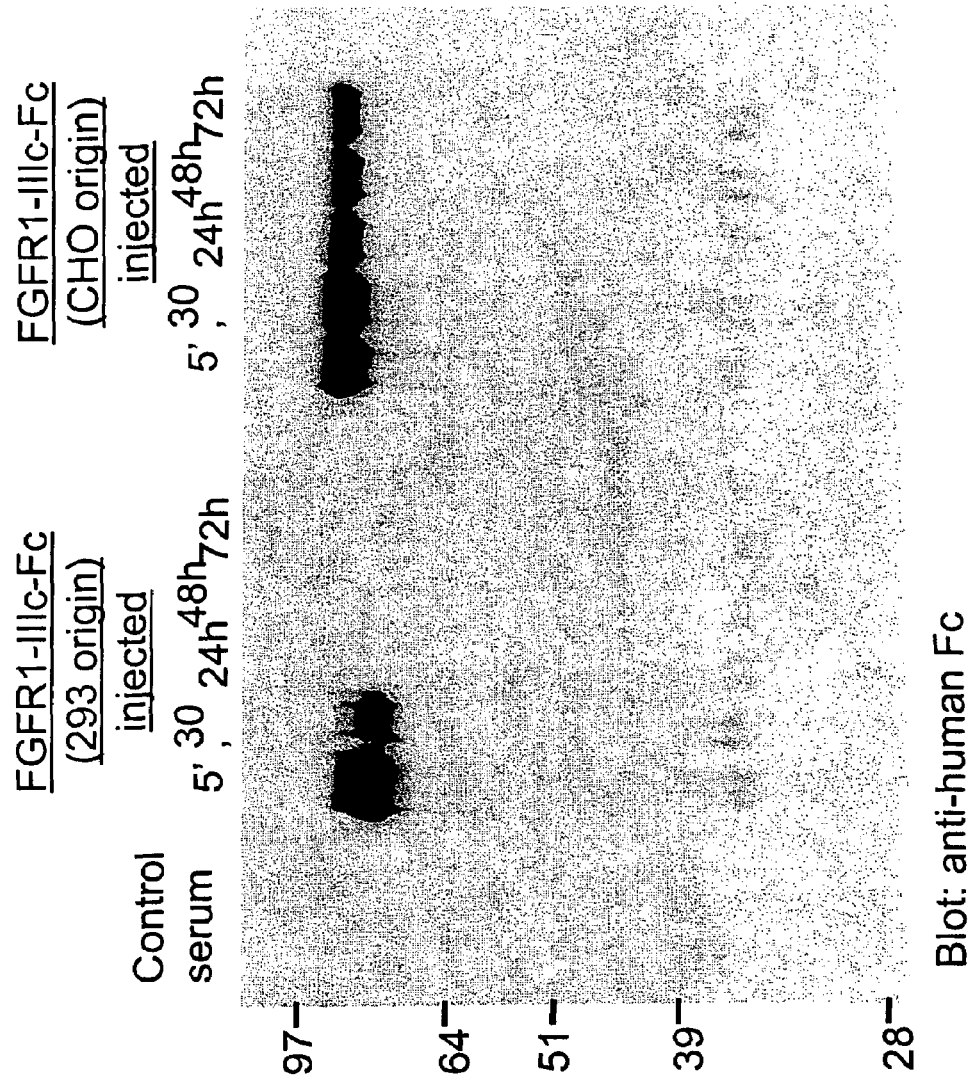
FIG. 26 shows a Western blot of sera taken from mice 5 min, 30 min, 24 hr, 48 hr, and 72 hr after injection with purified FGFR1-IIIc-Fc produced from 293 cells or from CHO cells, compared to control mouse serum. The blot shows immunoreactivity with anti-human Fc antibody and demonstrates that FGFR1-IIIc-Fc from CHO cells persisted in the circulation longer (more than 72 hours after injection) and thus was more stable in vivo than FGFR1-IIIc-Fc from 293-6E cells, which was undetectable after 24 hours.

As shown in FIG. 26, FGFR1-IIIc-Fc purified from 293-6E cells and injected into mice was quickly degraded in vivo and was undetectable via Western blot by 24 hr post-injection. FGFR1-IIIc-Fc expressed from CHO-S cells was more stable in vivo and was readily detectable in the serum, even at 72 hr post-injection. This study showed that the CHO-S host cell-derived FGFR1-IIIc-Fc had a longer serum half life than the 293-6E host cell-derived material.

As also shown in FIG. 26, FGFR1-IIIc-Fc demonstrated different electrophoretic properties when expressed by 293-6E cells compared to CHO-S cells. FGFR1-IIIc-Fc produced by CHO-S cells had an apparent molecular weight of approximately 90 kDa on reducing SDS-PAGE gels and migrated to a position 3-4 kD higher than FGFR1-IIIc-Fc produced by 293-6E cells. Also, the appearance of the CHO-S-derived FGFR1-IIIc-Fc in the gel was more compact in comparison to the more diffuse gel band of the FGFR1-IIIc-Fc derived from 293-6E host cells.

EXAMPLE 18

In Vivo Inhibition of Tumor Growth By FGFR1-IIIc-Fc and R1Mut4

Xenograft models of tumor growth can be used to assess the in vivo inhibitory properties of cancer therapeutic agents. Caki-1 human kidney tumor cells (ATCC; Manassas, Va.) form tumors when injected into severe combined immunodeficient CB17 scid/scid (CB17SCID) mice. Treatment with FGFR1-IIIc-Fc or R1Mut4 following the injection of the tumor cells decreases the size of the tumors which form in the mice.

Figure 25:
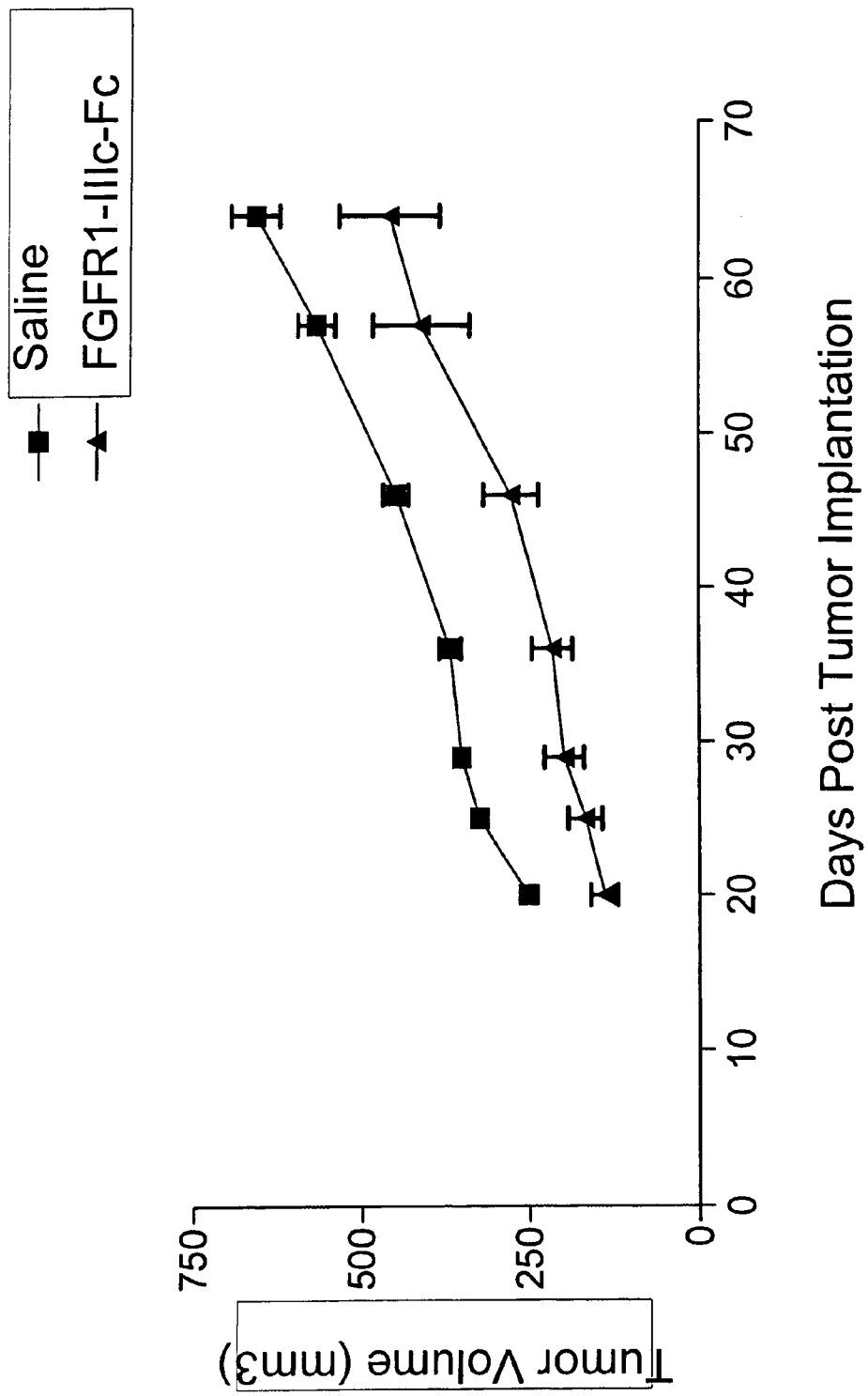
FIG. 25 shows the inhibitory effect of FGFR1-IIIc-Fc on Caki-1 tumor growth in an in vivo xenograft mouse model of tumor growth in which mice were injected with "mini-circle" vector cDNA encoding FGFR1-IIIc-Fc using the hydrodynamic tail vein injection method. The tumor volume increased more slowly in the animals treated with FGFR1-IIIc-Fc than with saline.

Treating mice with FGFR1-IIIc-Fc via hydrodynamic tail vein transfection following the injection of Caki-1 tumor cells reduced the volume of the tumors which formed in the mice, as compared to animals mock-transfected with saline. Nine-week old female CB17SCID mice (Charles River Laboratory) were subcutaneously implanted with $1.5 \times 10^7$ Caki-1 cells in a volume of 200 µl. On day 5 post-tumor implantation, "mini-circle" FGFR1-IIIc-Fc cDNA was delivered at a concentration of 7.5 µg/ml by hydrodynamic tail vein transfection to 13 animals, as described in Example 15. Two ml of the FGFR1-IIIc-Fc cDNA composition comprising 15 µg FGFR1-IIIc-Fc cDNA was injected into the tail vein within 5-8 seconds. Saline was injected into 13 control mice. The resulting tumors were measured by caliper at days 20, 25, 29, 36, 46, 57, and 64. The tumor volume (mm$^3$) was calculated by the formula $(\pi/6)*L^2*W$, in which L (mm) designated the length and W (mm) designated the width of the tumor. The results, shown in FIG. 25, demonstrated that FGFR1-IIIc-Fc expression inhibited Caki-1 tumor growth by about 25% to 50% at all measured time points, as compared to the saline-treated controls.

Recombinant FGFR1-IIIc-Fc also reduced the volume of Caki-1 tumors in mice. FGFR1-IIIc-Fc was expressed by CHO-S host cells and purified as described in Example 7. Forty eight CB17SCID mice were injected subcutaneously in the flank with $1.5 \times 10^7$ human tumor Caki-1 cells in a PBS vehicle with an injection volume of 200 µl and assigned to one of four treatment groups. Group 1 (n=12) received saline only; Group 2 (n=11) received 1 mg/kg FGFR1-IIIc-Fc; Group 3 (n=12) received 5 mg/kg FGFR1-IIIc-Fc; and Group 4 (n=13) received 15 mg/kg FGFR1-IIIc-Fc. Saline or FGFR1-IIIc-Fc treatment began one day after the tumors were injected and was given twice a week by injecting the appropriate dose of FGFR1-IIIc-Fc into the tail vein in a volume of 2001 with saline vehicle. Group 1 control mice received only PBS vehicle injections.

Figure 30A:
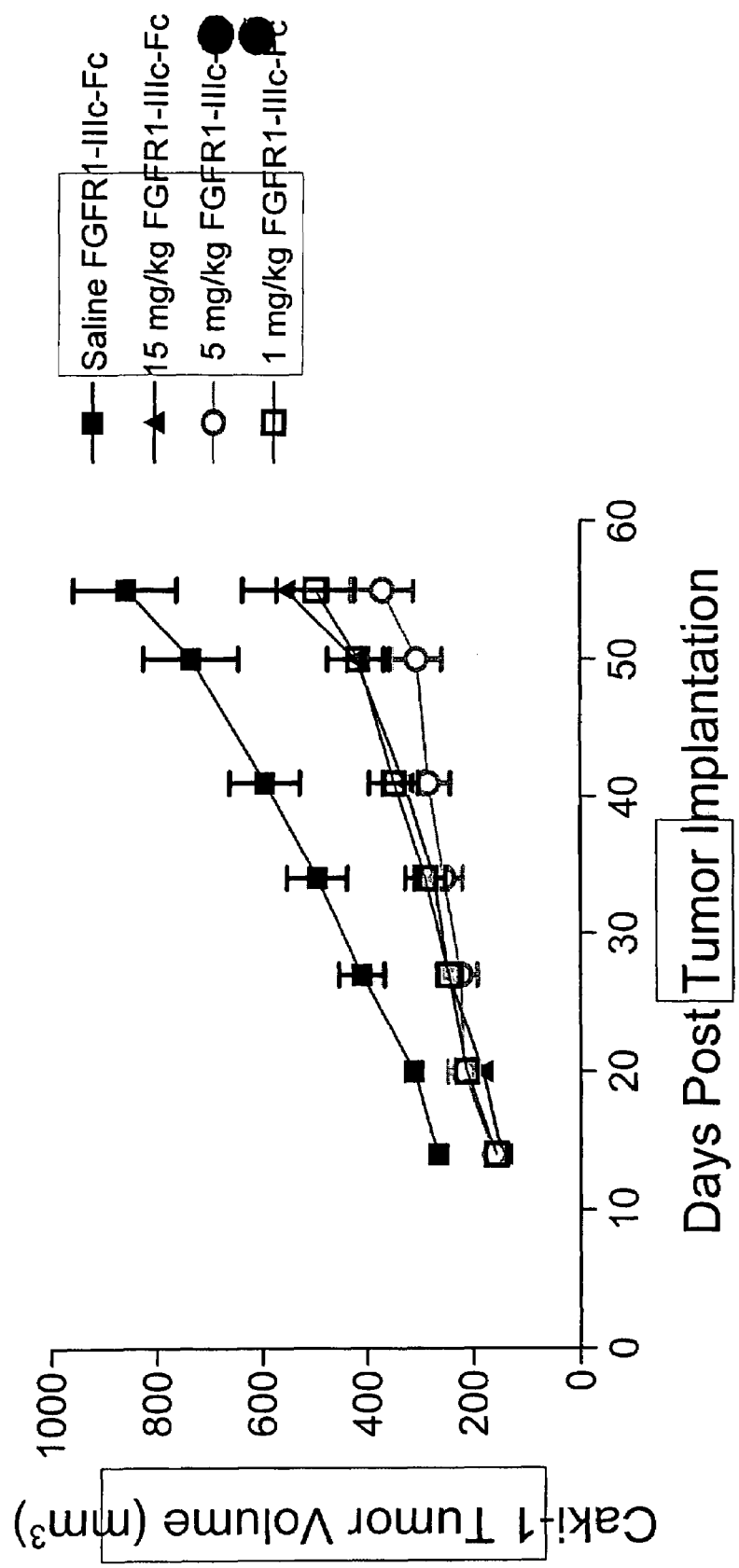
FIG. 30A shows the inhibitory effect of three concentrations of FGFR1-IIIc-Fc on Caki-1 tumor growth in an in vivo xenograft mouse model of tumor growth in which mice were injected intravenously with FGFR1-IIIc-Fc fusion protein.

The length and width of each tumor resulting from the injected Caki-1 cells were measured with a caliper and the tumor volume was calculated using the equation volume=$(\pi/6)*L^2*W$, as described above. Measurements were made at seven time points between day 14 and day 57 following injection of the Caki-1 cells. The results are shown in FIG. 30A. FGFR1-IIIc-Fc inhibited the growth of the Caki-1 cell-induced tumors by about 50% on day 57. All three doses of FGFR1-IIIc-Fc inhibited growth to approximately the same extent.

The above experiment was also repeated using different a lower dose range of FGFR1-IIIc-Fc and a single dose of R1Mut4. The FGFR1-IIIc-Fc protein was produced in CHO-S host cells and the R1Mut4 protein was produced in DG44 host cells and the proteins purified as described in Example 7.

Ninety CB17SCID mice were injected subcutaneously in the flank with $1.5 \times 10^7$ human tumor Caki-1 cells in a PBS vehicle with an injection volume of 200 µl and assigned to one of six treatment groups. Group 1 (n=15) received saline only; Group 2 (n=15) received 5 mg/kg FGFR1-IIIc-Fc; Group 3 (n=14) received 1 mg/kg FGFR1-IIIc-Fc; Group 4 (n=14) received 0.3 mg/kg FGFR1-IIIc-Fc; Group 5 (n=15) received 0.1 mg/kg FGFR1-IIIc-Fc and Group 6 (n=17) received 5 mg/kg R1Mut4. Saline, FGFR1-IIIc-Fc or R1Mut4 treatment began one day after the tumors were injected and was given twice a week by injecting the appropriate dose of FGFR1-IIIc-Fc into the tail vein in a volume of 200 µl with saline vehicle. Group 1 control mice received only PBS vehicle injections.

Figure 30B:
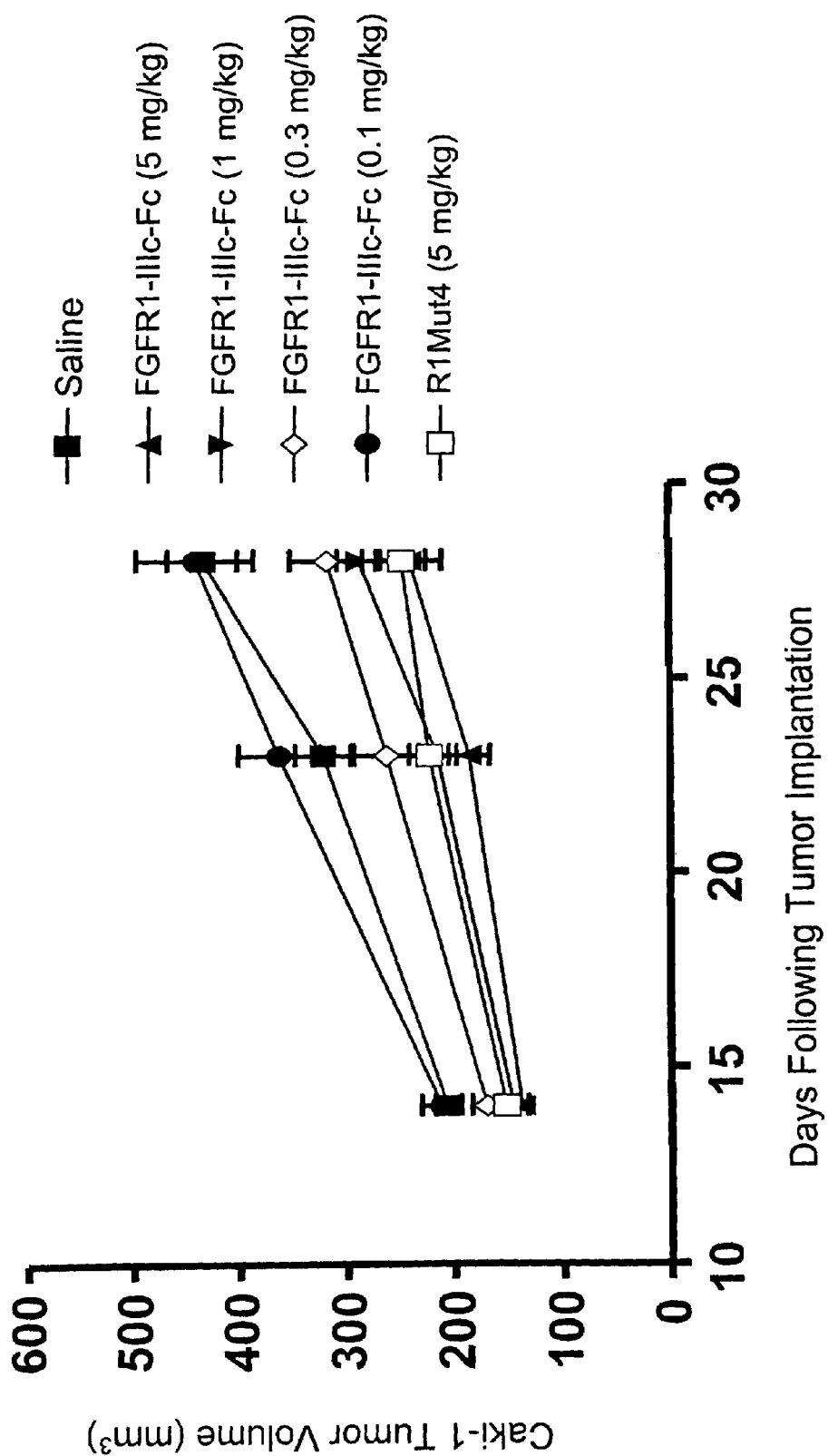
FIG. 30B shows the concentration-dependent inhibitory effect of FGFR1-IIIc-Fc and the inhibitory effect of R1Mut4 on Caki-1 tumor growth, as described in FIG. 30A.

The length and width of each tumor resulting from the injected Caki-1 cells were measured with a caliper and the tumor volume was calculated using the equation volume=$(\pi/6)*L^2*W$, as described above. Measurements were made at three time points between day 14 and day 27 following injection of the Caki-1 cells. The results are shown in FIG. 30B. Twice-weekly doses of 5 mg/ml of FGFR1-IIIc-Fc or R1Mut4 inhibited the growth of the Caki-1 cell-induced tumors by about 50% on day 27. This demonstrated that the R1Mut4 fusion protein was similarly potent in preventing tumor cell growth in vivo as the parental FGFR1-IIIc-Fc molecule. This experiment also demonstrated that doses of FGFR1-IIIc-Fc as low as 0.3 mg/ml, but not 0.1 mg/ml, inhibited tumor cell growth in a xenograft animal model.

EXAMPLE 19

FGFR1-IIIc-Fc Sialylation and Glycosylation by 293-6E and CHO-S Cells

To investigate the factors responsible for the differences in stability of FGFR1-IIIc-Fc expressed by 293-6E cells and CHO-S cells, the sialic acid content of the two fusion proteins was compared. FGFR1-IIIc-Fc produced by 293-6E cells had a different sialylation pattern than FGFR1-IIIc-Fc produced from CHO-S cells.

FGFR1-IIIc-Fc expressed by 293-6E host cells, FGFR1-IIIc-Fc expressed by CHO-S host cells, and R1Mut4 expressed by CHO-S host cells were analyzed for sialic acid content by high pH anion-exchange chromatography with pulsed amperometric detection (HPAEC-PAD) at the University of California at San Diego. Briefly, protein was treated with 2 M HOAc at 80° C. for 3 hr. Sialic acids from the samples were collected by ultra-filtration through a 3,000 NMWCO membrane and eluted from a Dionex CarboPac PA-1 HPAEC-PAD column (Dionex; Sunnyvale, Calif.) with a sodium acetate gradient separating the two common forms of mammalian sialic acids, N-acetylneuraminic acid (Neu5Ac) and N-glycolylneuraminic acid (Neu5Gc).

As shown in Table 4 below, FGFR1-IIIc-Fc produced from 293-6E host cells, and FGFR-IIIc-Fc and R1Mut4 from CHO-S host cells are differentially sialated, with higher levels of both the Neu5Ac and Neu5Gc types of sialic acid present in CHO-S cell-derived proteins. The increased sialic acid content of CHO-S-derived FGFR1-IIIc-Fc may account, in whole or in part, for the observed differences in molecular weight and in vivo stability.

TABLE 4

| Sialic Acid Analysis of FGFR1-IIIc-Fc and R1Mut4 | | | |
|---|---|---|---|
| Sample | nMoles/mg Protein | | |
| 1111 | Neu5Gc | Neu5Ac | Moles/Mole |
| FGFR1-IIIc-Fc (293 origin) | 0.05 | 66.8 | 4.37 |
| FGFR1-IIIc-Fc (CHO origin) | 0.73 | 190.82 | 12.47 |
| R1Mut4 (CHO origin) | 2.52 | 117.96 | 7.71 |

Figure 27:
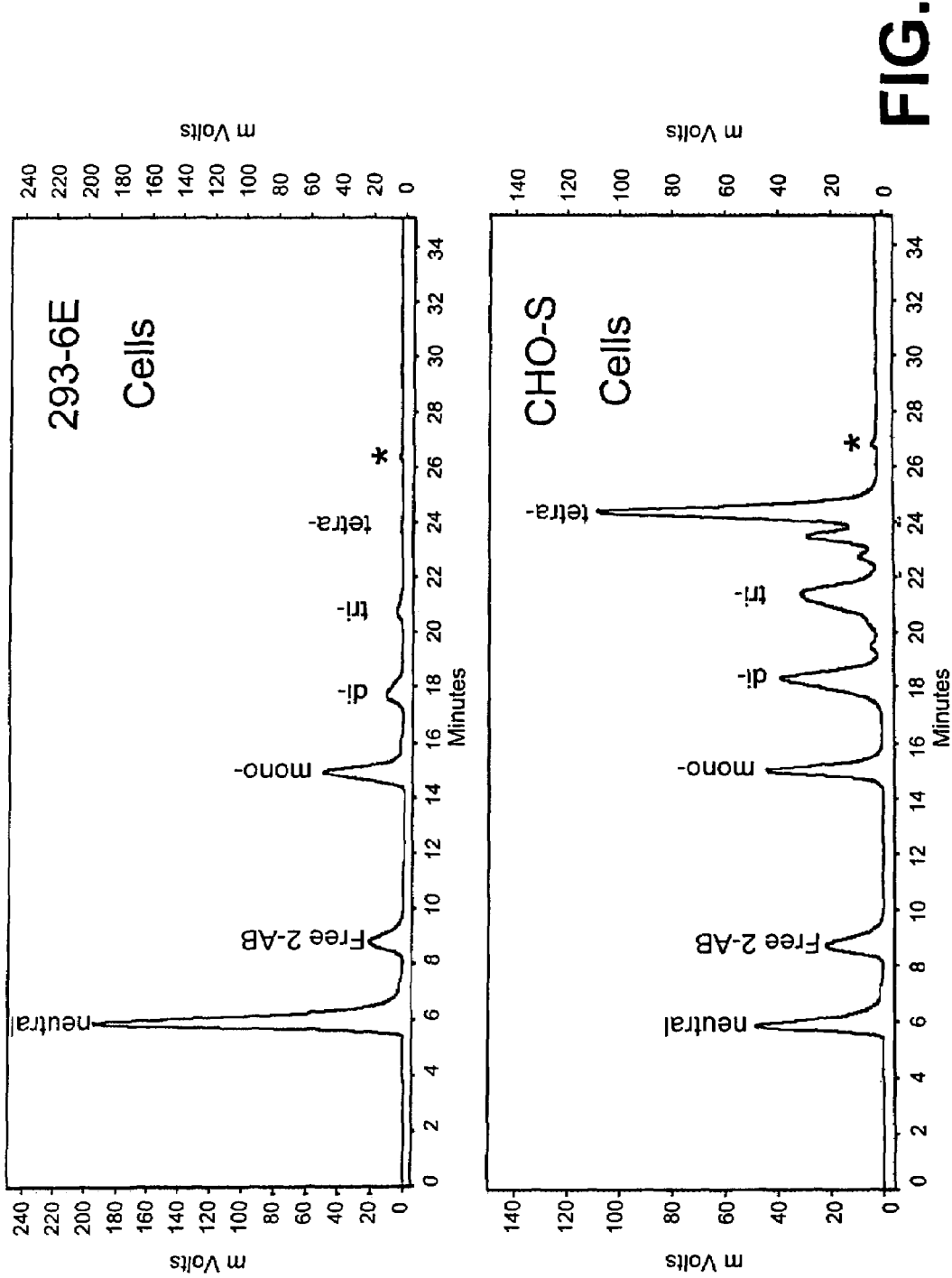
FIG. 27 shows a chromatographic analysis of the N-labeled glycans of FGFR1-IIIc-Fc expressed from 293-6E cells (upper panel) and CHO cells (lower panel).

FIG. 27 (upper panel) shows a chromatographic analysis of the N-labeled glycans of FGFR1-IIIc-Fc expressed from 293-6E cells, following their separation oil a Glycosep C column.

FIG. 27 (lower panel) shows the same separation performed on FGFR1-IIIc-Fc expressed from CHO-S cells. The chromatographic analysis was performed by Prozyme (San Leandro, Calif.). The N-labeled glycans were identified by comparison to a 2-aminobenzamide (2-AB) labeled bovine fetuin N-linked glycan library. The positions of the neutral glycans, free 2-AB labeled glycans, and mono-, di-, tri-, and tetra-sialylated glycans are indicated.

FGFR1-IIIc-Fc expressed from 293-6E cells predominantly expressed neutral glycans (asialo-glycans). In contrast, FGFR1-IIIc-Fc expressed from CHO cells predominantly expressed negatively charged sialylated glycans (about 86% of their carbohydrates). The negatively charged glycans of FGFR1-IIIc-Fc expressed from 293-6E host cells were mostly monosialylated, whereas the negatively charged glycans of FGFR1-IIIc-Fc expressed from CHO-S host cells comprised mono-, di-, tri-, and tetra-sialylated glycans, with the tetra-sialylated glycans comprising the major component. These results suggest that the differences in the levels of sialylation between FGFR1-IIIc-Fc of 293 cell origin and that of CHO-S cell origin could be responsible for the in vivo stability differences between the two proteins, as shown in Example 18.

EXAMPLE 20

Pharmacodynamic Studies of FGFR1-IIIc-Fc in Mice

Pharmacodynamic studies of FGFR1-IIIc-Fc in C57B16 mice show that the fusion protein is present in the serum for approximately 25 days post-injection and retains FGF-2 binding activity for approximately 14 days. The studies were performed by injecting mice with a fixed dose of recombinant FGFR1-IIIc-Fc expressed by CHO-S cells. Nine-week old female C57/B16 mice (Charles River Laboratory) were injected with 200 ul of FGFR1-IIIc-Fc protein solution at a final dose of 15 mg/kg. Serum samples (100 ul) were collected retroorbitally at 30 min, 5 hr, and days 1, 2, 3, 4, 5, 7, 14, and 25 post-injection; four mice were examined at each time point. The concentration of FGFR1-IIIc-Fc in the serum samples was analyzed both by direct ELISA and FGF-2 competition ELISA, as described in Example 15.

Figure 28:
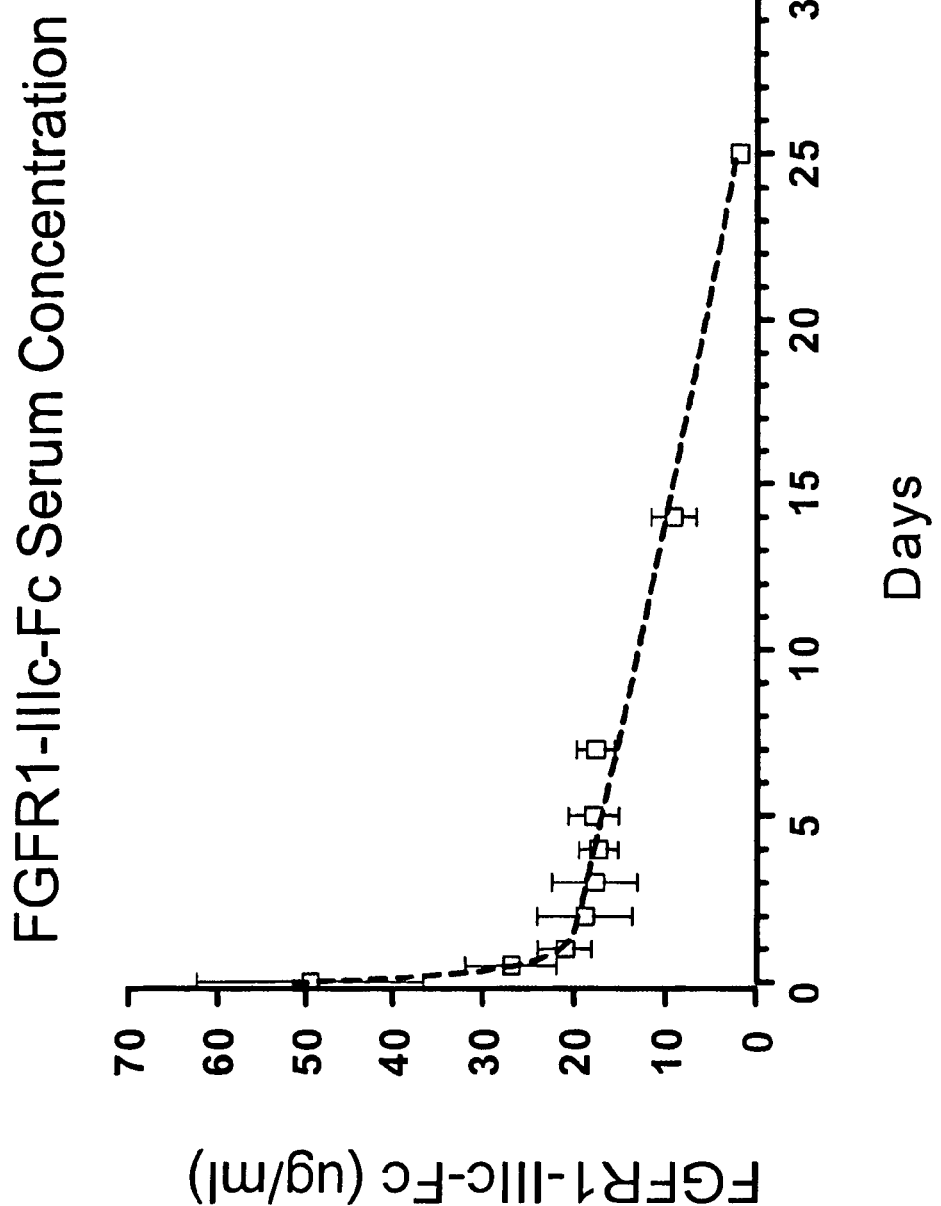
FIG. 28 shows the amount of FGFR1-IIIc-Fc in mouse serum measured for 25 days following injection of FGFR1-IIIc-Fc protein, as detected by quantitative direct ELISA.

The results of the FGFR1-IIIc-Fc direct ELISA are shown in FIG. 28. The concentration of FGFR1-IIIc-Fc was about 62 ug/ml at 30 min, 27 ug/ml at 5 hr, 21 ug/ml on day 1, 19 ug/ml on day 2, 18 ug/ml on day 3, 17 ug/ml on day 4, 18 ug/ml on day 5, 18 ug/ml on day 7, 10 ug/ml on day 14, and about 2 ug/ml on day 25. This result showed that the recombinant FGFR1-IIIc-Fc protein was stable in mice and was detectable at least until day 25 post-injection.

Figure 29:
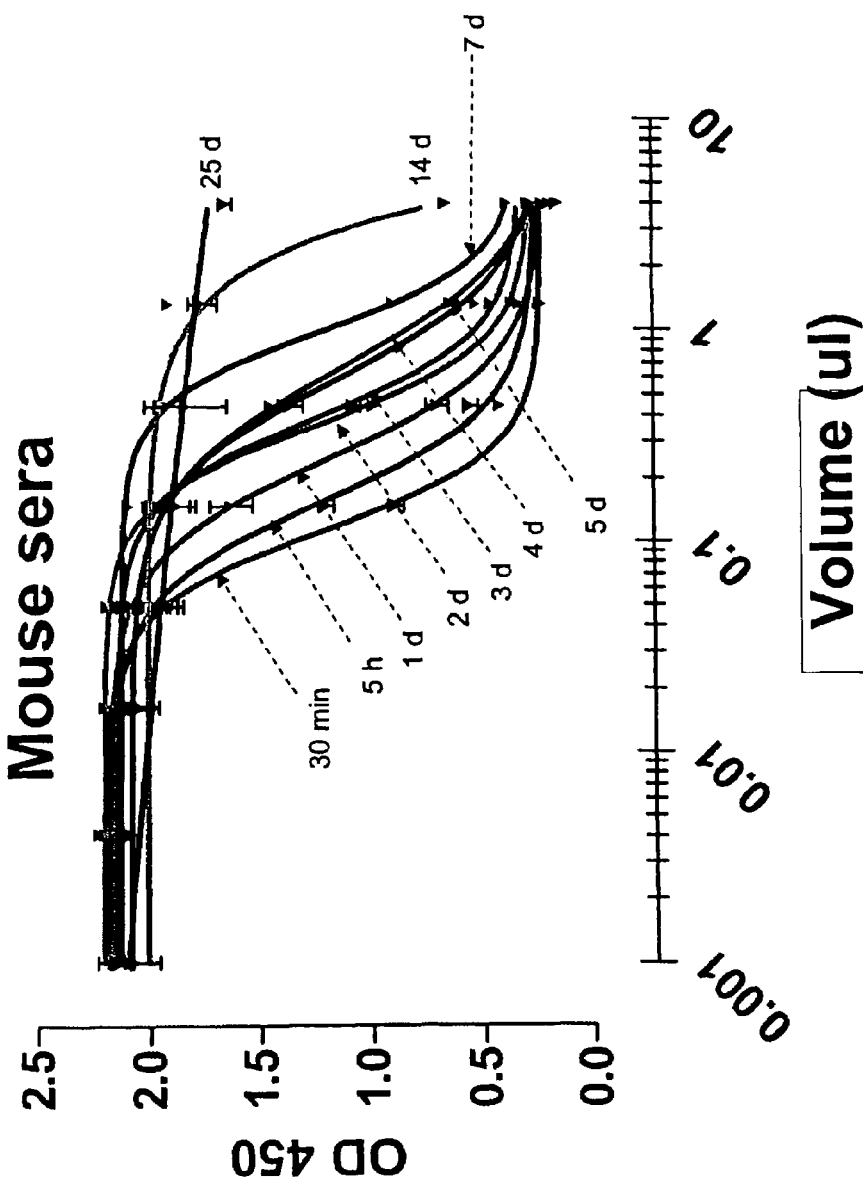
FIG. 29 shows the amount of functional FGFR1-IIIc-Fc present in the sera of mice 30 min, 5 hours, 1 day, 2 days, 3 days, 4 days, 5 days, 7 days, 14 days, and 25 days following injection with FGFR1-IIIc-Fc protein, as measured by a quantitative FGF-2 competition ELISA assay. The decrease in functional FGFR1-IIIc-Fc is measured as a decrease in $OD_{450}$ resulting from an increasing volume of serum (u1). Functional FGFR1-IIIc-Fc remains in mouse serum more than 14 days following injection with FGFR1-IIIc-Fc.

The results of the FGF-2 competition ELISA measuring the FGF-2 binding capacity of the serum FGFR1-IIIc-Fc are shown in FIG. 29. The sera were serially diluted and the amount of binding of the FGFR1-IIIc-Fc in the serum to FGF-2 (0.2 µg/ml) was measured. As shown in FIG. 29, FGF-2 binding by FGFR1-IIIc-Fc in the serum of the injected mice diminished with time, as seen by the rightward shift in the binding curves. FGF-2 binding ability roughly paralleled the amounts of FGFR1-IIIc-Fc measured by direct ELISA. FGF-2 binding activity remained detectable by the FGFR1-IIIc-Fc in the mouse sera at day 14 but by day 25, the competition ELISA was not able to detect FGF-2 binding activity in the amounts of mouse serum which were tested.

EXAMPLE 21

Pharmacodynamic Studies of R1Mut4 in Mice

Figure 31:
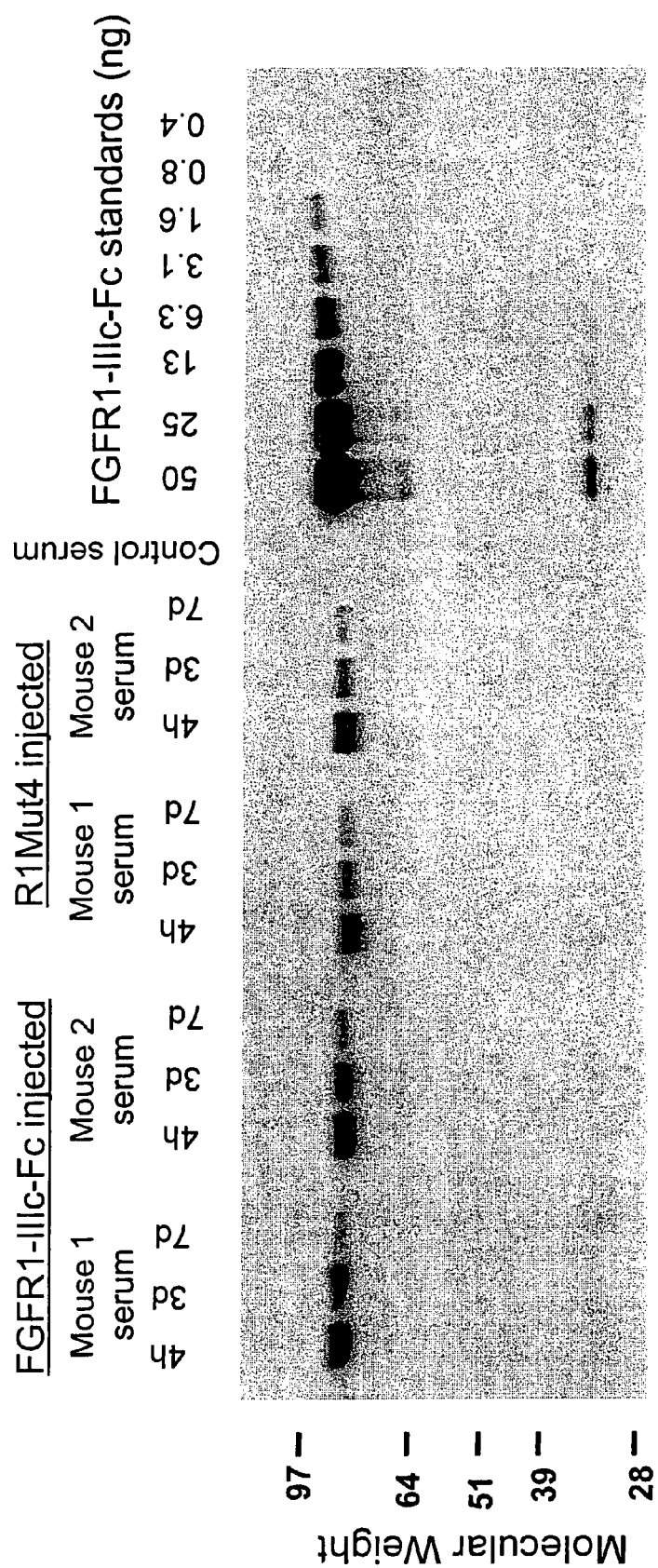
FIG. 31 shows a quantitative Western blot of sera from mice injected with either FGFR1-IIIc-Fc or R1Mut4 proteins at 4 hr, 3 days, and 7 days after injection, blotted with an anti-human Fc antibody, and compared to a set of FGFR1-IIIc-Fc standards. FGFR1-IIIc-Fc and R1Mut4 were both stable in vivo in mice up to at least about 7 days following injection with "mini-circle" vector cDNA encoding FGFR1-IIIc-Pc or R1Mut4 by hydrodynamic tail vein injection.

Pharmacodynamic studies of R1Mut4 in C57 mice show that R1Mut4 has approximately the same in vivo stability as FGFR1-IIIc-Fc. C57 mice (Charles River Laboratory) at 2-3 months of age were injected subcutaneously with a dose of 10 mg/kg FGFR1-IIIc-Fc or R1Mut4 in 200 ul of saline vehicle. The FGFR1-IIIc-Fc and R1Mut4 were both prepared by expression in a pcDNA3.1 vector in CHO-S cells, as described in Example 2. Serum samples (200 ul) were collected at 4 hr, 3 days, and 7 days post-injection. The concentrations of the FGFR1-IIIc-Fc and R1Mut4 proteins in the serum samples were analyzed by Western blot, as described in Example 5 and the results shown in FIG. 31. Four hours after injection, mice treated with FGFR1-IIIc-Fc and R1Mut4 showed about the same amount of reactivity with the anti-Fc antibody, about 6.3 ng or more, determined by comparison with the standards of known quantities of FGFR1-IIIc-Fc prepared from CHO-S cells and shown in the right panel. By day 3, the amount of protein present in the serum of all the animals had decreased to about 3.1 ng or more determined by comparison with the standards. By day 7, the amount of protein present in the serum of all the animals had decreased to about 1.6 ng or more. These results demonstrated that recombinant FGFR1-IIIc-Fc and R1Mut4 proteins had similar stability in vivo.

EXAMPLE 22

Over-Expression of FGFR1, FGFR3, and FGFR4 in Cancerous Tissues Relative to Normal Tissues The analysis and sorting of the expression data residing in the proprietary oncology database from GeneLogic (Gaithersburg, Md.) herein identified cancers that over-expressed FGFR1, FGFR3, and FGFR4 compared to corresponding normal tissues. These cancers are therapeutic targets for the FGFR fusion proteins of the invention. The GeneLogic database was generated by hybridizing Affymetrix U133 (Santa Clara, Calif.) microarray chips with cRNAs derived from over 3000 malignant tissue samples and with cRNAs derived from over 4500 normal tissue samples. The Affymetrix U133 microarray chip contains probes corresponding to FGFR1, probes corresponding to FGFR3, and probes corresponding to FGFR4.

Data derived from all malignant tissue samples and from all normal tissue samples were segregated into datasets corresponding to individual cancer types and to their corresponding normal tissues. Over 75 distinct cancer types are represented in the database. Cancer types with datasets containing samples expressing greater than the median expression value of FGFR1 in the corresponding normal tissue dataset, greater than the median expression value of FGFR3 in the corresponding normal tissue dataset, and greater than the median expression value of FGFR4 in the corresponding normal tissue dataset were considered to over-express FGFR1, to over-express FGFR3, or to over-express FGFR4, respectively. The proportion of samples in the dataset for any given cancer type over-expressing FGFR1, FGFR3, or FGFR4 was calculated as a percentage of the total number of samples in that dataset, as shown in Table 5.

TABLE 5

FGFR1, FGFR2, and FGFR4 Over-expression in Malignant Tissues

| Cancer Type | Percent of Malignant Tissue Samples Over-expressing FGFR1, FGFR3, or FGFR4 | | |
|---|---|---|---|
| | FGFR1 | FGFR3 | FGFR4 |
| Leukemia | | | |
| B-cell acute lymphoblastic leukemia | 100 | | |
| Chronic myelomonocytic leukemia | 100 | | |
| Chronic lymphocytic leukemia | 100 | | |
| Chronic myeloid leukemia | 75 | | |
| Lymphoma | | | |
| Burkitt"s tumor of extranodal site | | 7 | |
| Hodgkin's disease of lymph nodes | 6 | | |
| Malignant lymphoma of extranodal site | 12 | | |
| Malignant lymphoma, non-Hodgkin's type | 16 | | 1 |
| Myeloma | | | |
| Plasmacytoma | 50 | | |
| Sarcoma | | | |
| Malignant neoplasm of bone | 83 | 35 | 3 |
| Malignant neoplasm of heart | | | 100 |
| Malignant neoplasm of soft tissues | 37 | 15 | 7 |
| Neurologic | | | |
| Malignant neoplasm of brain | 89 | 21 | |
| Breast | | | |
| Malignant neoplasm of female breast | 16 | 24 | 13 |
| Malignant neoplasm of male breast | | 25 | |
| Digestive tract/Gastrointestinal | | | |
| Malignant neoplasm of ampulla of Vater | 50 | 25 | |
| Malignant neoplasm of appendix | 50 | | |
| Malignant neoplasm of colon | 30 | 17 | 45 |
| Malignant neoplasm of duodenum | 63 | 18 | 36 |
| Malignant neoplasm of esophagus | 22 | 18 | 55 |
| Malignant neoplasm of gallbladder | | 66 | 33 |
| Malignant neoplasm of liver | 32 | 55 | 52 |
| Malignant neoplasm of pancreas | 11 | 28 | 14 |
| Malignant neoplasm of the peritoneum | 35 | | |
| Malignant neoplasm of rectum | 26 | 14 | 59 |
| Malignant neoplasm of small intestine | 69 | 30 | 7 |
| Malignant neoplasm of stomach | 30 | 14 | 28 |
| Endocrine Cancers | | | |
| Malignant neoplasm of adrenal gland | 50 | | 100 |
| Malignant neoplasm of islets of Langerhans | 9 | 45 | 45 |
| Malignant neoplasm of thyroid gland | 43 | 3 | |
| Eye | | | |
| Malignant neoplasm of eye | 50 | | |
| Genitourinary | | | |
| Malignant neoplasm of bladder | 8 | 56 | |
| Malignant neoplasm of kidney | 77 | 5 | 27 |
| Malignant neoplasm of prostate | 11 | 23 | |
| Malignant neoplasm of testis | 80 | 100 | 38 |
| Malignant neoplasm of ureter | | 100 | |
| Gynecologic | | | |
| Malignant neoplasm of uterine cervix | 26 | 52 | |
| Malignant neoplasm of myometrium | 100 | | |
| Malignant neoplasm of ovary | 16 | 13 | 6 |
| Malignant neoplasm of uterus | 60 | 20 | |
| Malignant neoplasm of endometrium | 69 | 16 | 7 |
| Malignant neoplasm of placenta | 100 | | |
| Malignant neoplasm of vulva | 5 | 5 | |
| Head & Neck | | | |
| Malignant neoplasm of larynx | 36 | 26 | |
| Malignant neoplasm of major salivary gland | 66 | | |
| Malignant neoplasm of nasal cavity | 100 | | |
| Malignant neoplasm of oral cavity | 20 | 60 | |
| Malignant neoplasm of parotid gland | 27 | 18 | 9 |
| Malignant neoplasm of tongue | 71 | 14 | |
| Malignant neoplasm of tonsil | | 100 | |
| Respiratory/Thoracic | | | |
| Malignant neoplasm of lung | 28 | 35 | 4 |
| Malignant neoplasm of thymus | 50 | | |
| Malignant neoplasm of trachea | 100 | | |
| Skin | | | |
| Malignant neoplasm of skin | 22 | 16 | 1 |

FGFR1 was over-expressed in leukemia, including B-cell acute lymphoblastic leukemia, chronic myelomonocytic leukemia, chronic lymphocytic leukemia, and chronic myeloid leukemia; in lymphoma, including Hodgkin's lymphoma, non-Hodgkin's lymphoma, and extranodal lymphoma; in myeloma, including plasmacytoma; in sarcoma, including malignant neoplasms of the bone and soft tissues; in neurologic cancer, including malignant neoplasms of the brain; in breast cancer, including malignant neoplasms of the female breast; in digestive tract/gastrointestinal cancer, including malignant neoplasms of the ampulla of Vater, appendix, colon, duodenum, esophagus, liver, pancreas, peritoneum, rectum, small intestine, and stomach; in endocrine cancer, including malignant neoplasms of the adrenal gland, islets of Langerhans, and thyroid gland; in eye cancer, including malignant neoplasms of the eye; in genitourinary cancer, including malignant neoplasms of the bladder, kidney, prostate, and testis; in gynecologic cancer, including malignant neoplasms of the uterine cervix, myometrium, ovary, uterus, endometrium, placenta, and vulva; in head and neck cancer, including malignant neoplasms of the larynx, salivary gland, nasal cavity, oral cavity, parotid gland, and tongue; in respiratory/thoracic cancer, including malignant neoplasms of the lung, thymus, and trachea; and in skin cancer, including malignant neoplasms of the skin (Table 5).

FGFR3 was over-expressed in lymphoma, including Burkitt's lymphoma; in sarcoma, including malignant neoplasms of the bone and soft tissues; in neurologic cancer, including malignant neoplasms of the brain; in breast cancer, including malignant neoplasms of the female breast and male breast; in digestive tract/gastrointestinal cancer, including malignant neoplasms of the ampulla of Vater, colon, duodenum, esophagus, gallbladder, liver, pancreas, rectum, small intestine, and stomach; in endocrine cancer, including malignant neoplasms of the islets of Langerhans and thyroid gland; in genitourinary cancer, including malignant neoplasms of the bladder, kidney, prostate, testis, and ureter; in gynecologic cancer, including malignant neoplasms of the uterine cervix, ovary, uterus, endometrium, and vulva; in head and neck cancer, including malignant neoplasms of the larynx, oral cavity, parotid gland, tongue, and tonsil; in respiratory/thoracic cancer, including malignant neoplasms of the lung; and in skin cancer, including malignant neoplasms of the skin (Table 5).

FGFR4 was over-expressed in lymphoma, including non-Hodgkin's lymphoma; in sarcoma, including malignant neoplasms of the bone, heart, and soft tissues; in breast cancer, including malignant neoplasms of the female breast; in digestive tract/gastrointestinal cancer, including malignant neoplasms of the colon, duodenum, esophagus, gallbladder, liver, pancreas, rectum, small intestine, and stomach; in endocrine cancer, including malignant neoplasms of the adrenal gland and islets of Langerhans; in genitourinary cancer, including malignant neoplasms of the kidney and testis; in gynecologic cancer, including malignant neoplasms of the ovary and endometrium; in head and neck cancer, including malignant neoplasms of the parotid gland; in respiratory/thoracic cancer, including malignant neoplasms of the lung; and in skin cancer, including malignant neoplasms of the skin (Table 5).

Table 4 identifies tumors which over-expressed more than one FGFR, for example, malignant hyphoma, non-Hodgkin's type over-expressed FGFR1 and FGFR4; malignant neoplasm of bone, soft tissues, female breast, colon, duodenum, esophagus, liver, rectum, small intestine, stomach, islets of Langerhans, kidney, testis, ovary, endometrium, parotid gland, lung, and skin over-expressed FGFR1, FGFR3, and FGFR4; malignant neoplasm of brain, ampulla of Vater, thyroid gland, bladder, prostate, uterine cervix, uterus, vulva, larynx, oral cavity, and tongue over-expressed FGFR1 and FGFR3; and malignant neoplasm of the gall bladder over-expressed FGFR3 and FGFR4.

Our analysis indicated that FGFR1, and FGFR3, and/or FGFR4 were often over-expressed in cancer. This over-expression implicates active FGF signaling pathways in maintaining the viability and proliferative capability of the affected tumors. We concluded that blocking these signaling pathways in the affected tumors, such as with decoy receptors like FGFR1-Fc, FGFR3-Fc and FGFR4-Fc fusion proteins, or their variants will reduce the viability and proliferative capacity of these tumors.

EXAMPLE 23

Over-Expression of FGF-1, FGF-2, FGF-4, and FGF-5 in Cancerous Tissues Relative to Normal Tissues An analysis of the GeneLogic (Gaithersburg, Md.) database for the expression of FGF-1, FGF-2, FGF-4, and FGF-5 in cancer tissue types and in corresponding normal tissue types was performed essentially as described in Example 22. The Affymetrix U133 microarray chip contains probes corresponding to FGF-1, FGF-2, FGF-4, and FGF-5. The proportion of samples in the dataset of any given cancer type over-expressing FGF-1, FGF-2, FGF-4, or FGF-5 was calculated as a percentage of the total number of samples in that dataset and is shown in Table 6. Cancers which over-expressed FGF-1, FGF-2, FGF-4, and FGF-5 compared to corresponding normal tissues are therapeutic targets for the FGFR fusion proteins of the invention.

TABLE 6

FGF-1, FGF-2, FGF-4, and FGF-5 Over-expression in Malignant Tissues

| Cancer Type | Percent of Malignant Tissue Samples Over-expressing FGF-1, FGF-2, FGF-4, or FGF-5 | | | |
|---|---|---|---|---|
| | FGF-1 | FGF-2 | FGF-4 | FGF-5 |
| Leukemia | | | | |
| Acute monocytic/monoblastic leukemia | 100 | | | |
| Chronic lymphocytic leukemia | | | | |
| Prolymphocytic leukemia | | | 100 | |
| Chronic myeloid leukemia | 25 | | | |
| Lymphoma | | | | |
| Burkitt''s tumor of extranodal site | 100 | | | |
| Hodgkin's disease of lymph nodes | 20 | 6 | | |
| Malignant lymphoma of extranodal site | 12 | 3 | 3 | |
| Malignant lymphoma, non-Hodgkin's type | 10 | 11 | 6 | |
| Myeloma | | | | |
| Plasmacytoma | | 50 | | |
| Sarcoma | | | | |
| Malignant neoplasm of bone | 29 | 29 | 3 | 6 |
| Malignant neoplasm of heart | | 100 | 100 | |
| Malignant neoplasm of soft tissues | 25 | 42 | 4 | 18 |
| Neurologic | | | | |
| Malignant neoplasm of brain | 3 | 53 | 3 | |
| Breast | | | | |
| Malignant neoplasm of female breast | 19 | 5 | 7 | |
| Malignant neoplasm of male breast | 50 | | | 25 |
| Digestive tract/Gastrointestinal | | | | |
| Malignant neoplasm of ampulla of Vater | | 50 | 25 | |
| Malignant neoplasm of appendix | | 50 | | |
| Malignant neoplasm of colon | 11 | 12 | 7 | |
| Malignant neoplasm of duodenum | | 18 | | |
| Malignant neoplasm of esophagus | 7 | 22 | 3 | |
| Malignant neoplasm of gallbladder | 33 | | | |
| Malignant neoplasm of liver | 20 | 23 | 11 | 8 |
| Malignant neoplasm of pancreas | 30 | 53 | 8 | |
| Malignant neoplasm of the peritoneum | 7 | | 7 | 7 |
| Malignant neoplasm of rectum | 5 | 8 | 3 | |
| Malignant neoplasm of small intestine | 30 | 53 | | |
| Malignant neoplasm of stomach | 19 | 28 | 9 | |
| Endocrine Cancers | | | | |
| Malignant neoplasm of adrenal gland | | 50 | | |
| Malignant neoplasm of islets of Langerhans | 18 | 63 | 9 | |
| Malignant neoplasm of thyroid gland | 22 | 30 | 7 | 1 |
| Eye | | | | |
| Malignant neoplasm of eye | | | | |
| Genitourinary | | | | |
| Malignant neoplasm of bladder | 8 | 8 | 4 | |
| Malignant neoplasm of kidney | 2 | 48 | 6 | |
| Malignant neoplasm of prostate | 8 | 5 | 4 | |
| Malignant neoplasm of testis | 28 | 52 | 42 | |
| Malignant neoplasm of ureter | 33 | | | |
| Gynecologic | | | | |
| Malignant neoplasm of fallopian tube | 33 | | 33 | |
| Malignant neoplasm of uterine cervix | 17 | 8 | 13 | |
| Malignant neoplasm of myometrium | 11 | 22 | 11 | |
| Malignant neoplasm of ovary | 12 | 9 | 6 | 1 |
| Malignant neoplasm of uterus | | | | |
| Malignant neoplasm of endometrium | 19 | 12 | 23 | 2 |
| Malignant neoplasm of placenta | | 100 | | |
| Malignant neoplasm of vulva | 40 | 25 | 5 | |

TABLE 6-continued

FGF-1, FGF-2, FGF-4, and FGF-5 Over-expression in Malignant Tissues

| Cancer Type | Percent of Malignant Tissue Samples Over-expressing FGF-1, FGF-2, FGF-4, or FGF-5 | | | |
|---|---|---|---|---|
| | FGF-1 | FGF-2 | FGF-4 | FGF-5 |
| Head & Neck | | | | |
| Malignant neoplasm of larynx | 21 | 10 | 15 | |
| Malignant neoplasm of major salivary gland | 33 | 66 | | |
| Malignant neoplasm of parotid gland | 18 | 54 | | 9 |
| Malignant neoplasm of tongue | 42 | 28 | 28 | |
| Malignant neoplasm of tonsil | | | | |
| Respiratory/Thoracic | | | | |
| Malignant neoplasm of lung | 20 | 13 | 8 | 1 |
| Malignant neoplasm of thymus | | 50 | | |
| Malignant neoplasm of trachea | | 100 | | |
| Skin | | | | |
| Malignant neoplasm of skin | 27 | 19 | 3 | 6 |

FGF-1 was over-expressed in leukemia, including acute monocytic/monoblastic leukemia and chronic myeloid leukemia; in lymphoma, including Burkitt's lymphoma, Hodgkin's lymphoma and non-Hodgkin's lymphoma, and extranodal lymphoma; in sarcoma, including malignant neoplasms of the bone and soft tissues; in neurologic cancer, including malignant neoplasms of the brain; in breast cancer, including malignant neoplasms of the female breast and male breast; in digestive tract/gastrointestinal cancer, including malignant neoplasms of the colon, esophagus, gallbladder, liver, pancreas, peritoneum, rectum, small intestine, and stomach; in endocrine cancer, including malignant neoplasms of the islets of Langerhans and thyroid gland; in genitourinary cancer, including malignant neoplasms of the bladder, kidney, prostate, testis, and ureter; in gynecologic cancer, including malignant neoplasms of the fallopian tube, uterine cervix, myometrium, ovary, endometrium, and vulva; in head and neck cancer, including malignant neoplasms of the larynx, salivary gland, parotid gland, and tongue; in respiratory/thoracic cancer, including malignant neoplasms of the lung; and in skin cancer, including malignant neoplasms of the skin (Table 6).

FGF-2 was over-expressed in lymphoma, including Hodgkin's lymphoma, non-Hodgkin's lymphoma, and extranodal lymphoma; in myeloma, including plasmacytoma; in sarcoma, including malignant neoplasms of the bone, heart, and soft tissues; in neurologic cancer, including malignant neoplasms of the brain; in breast cancer, including malignant neoplasms of the female breast; in digestive tract/gastrointestinal cancer, including malignant neoplasms of the ampulla of Vater, appendix, colon, duodenum, esophagus, liver, pancreas, rectum, small intestine, and stomach; in endocrine cancer, including malignant neoplasms of the adrenal gland, islets of Langerhans and thyroid gland; in genitourinary cancer, including malignant neoplasms of the bladder, kidney, prostate, and testis; in gynecologic cancer, including malignant neoplasms of the uterine cervix, myometrium, ovary, endometrium, placenta, and vulva; in head and neck cancer, including malignant neoplasms of the larynx, salivary gland, parotid gland, and tongue; in respiratory/thoracic cancer, including malignant neoplasms of the lung, thymus, and trachea; and in skin cancer, including malignant neoplasms of the skin (Table 6).

FGF-4 was over-expressed in leukemia, including pro-lymphocytic leukemia; in lymphoma, including non-Hodgkin's lymphoma and extranodal lymphoma; in sarcoma, including malignant neoplasms of the bone, heart, and soft tissues; in neurologic cancer, including malignant neoplasms of the brain; in breast cancer, including malignant neoplasms of the female breast; in digestive tract/gastrointestinal cancer, including malignant neoplasms of the ampulla of Vater, colon, esophagus, liver, pancreas, peritoneum, rectum, and stomach; in endocrine cancer, including malignant neoplasms of the islets of Langerhans and thyroid gland; in genitourinary cancer, including malignant neoplasms of the bladder, kidney, prostate, and testis; in gynecologic cancer, including malignant neoplasms of the fallopian tube, uterine cervix, myometrium, ovary, endometrium, and vulva; in head and neck cancer, including malignant neoplasms of the larynx and tongue; in respiratory/thoracic cancer, including malignant neoplasms of the lung; and in skin cancer, including malignant neoplasms of the skin (Table 6).

FGF-5 was over-expressed in sarcoma, including malignant neoplasms of the bone and soft tissues; in breast cancer, including malignant neoplasms of the male breast; in digestive tract/gastrointestinal cancer, including malignant neoplasms of the liver and peritoneum; in endocrine cancer, including malignant neoplasms of the thyroid gland; in gynecologic cancer, including malignant neoplasms of the ovary and endometrium; in head and neck cancer, including malignant neoplasms of the parotid gland; in respiratory/thoracic cancer, including malignant neoplasms of the lung; and in skin cancer, including malignant neoplasms of the skin (Table 6).

Table 6 demonstrates that FGF-1, FGF-2, FGF-4 and FGF-5, were often over-expressed in cancer. This over-expression implicates active FGF signaling pathways in maintaining viability or proliferative capability of the affected tumors. Blocking these signaling pathways in the affected tumors, such as by blocking the interactions between FGF-1, FGF-2, FGF-4, and FGF-5 and their respective receptors with decoy receptors, such as FGFR-1, FGFR3, FGFR4-Fc fusion proteins, or their variants will reduce the viability and proliferative capacity of these tumors.

EXAMPLE 24

Over-Expression of FGF-8, FGF-17, FGF-18, FGF-9, and FGF-20 in Cancerous Tissues Relative to Normal Tissues An analysis of the GeneLogic (Gaithersburg, Md.) database for the expression of FGF-8, FGF-17, FGF-18, FGF-9, or FGF-20 in cancer tissue types and in corresponding normal tissue types was performed essentially as described in Example 22. The Affymetrix U133 microarray chip contains probes corresponding to FGF-8, FGF-17, FGF-18, FGF-9, and FGF-20. The proportion of samples in the dataset of any given cancer type over-expressing FGF-8, FGF-17, FGF-18, FGF-9, or FGF-20 was calculated as a percentage of the total number of samples in that dataset and is shown in Table 6. Cancers which over-expressed FGF-8, FGF-17, FGF-18, FGF-9, and FGF-20 compared to corresponding normal tissues are therapeutic targets for the FGFR fusion proteins of the invention.

TABLE 7

FGF-8, FGF-17, FGF-18, FGF-9, and FGF-20 Over-expression in Malignant Tissues

Percent of Malignant Tissue Samples Over-expressing FGF-8, FGF-17, FGF-18, FGF-9, or FGF-20

| Cancer Type | FGF-8 | FGF-17 | FGF-18 | FGF-9 | FGF-20 |
|---|---|---|---|---|---|
| Leukemia | | | | | |
| B-cell acute lymphoblastic leukemia | | | | 100 | |
| Lymphoma | | | | | |
| Burkitt"s tumor of extranodal site | | | | 1 | |
| Malignant lymphoma of extranodal site | | | 3 | | |
| Malignant lymphoma, non-Hodgkin's type | | | 1 | 1 | |
| Sarcoma | | | | | |
| Malignant neoplasm of bone | | | 6 | 32 | |
| Malignant neoplasm of soft tissues | | 2 | 32 | 16 | |
| Neurologic | | | | | |
| Malignant neoplasm of brain | | | | 32 | |
| Breast | | | | | |
| Malignant neoplasm of female breast | | | 9 | 2 | |
| Malignant neoplasm of male breast | | | 25 | | |
| Digestive tract/Gastrointestinal | | | | | |
| Malignant neoplasm of ampulla of Vater | | | 25 | | |
| Malignant neoplasm of appendix | | | 50 | 50 | |
| Malignant neoplasm of colon | | | 12 | 7 | 1 |
| Malignant neoplasm of esophagus | | | 22 | 3 | |
| Malignant neoplasm of gallbladder | | | 66 | 33 | |
| Malignant neoplasm of liver | | | 2 | | |
| Malignant neoplasm of pancreas | | | 22 | 2 | |
| Malignant neoplasm of the peritoneum | | | 85 | 35 | |
| Malignant neoplasm of rectum | | | 21 | 5 | |
| Malignant neoplasm of small intestine | | | | 23 | |
| Malignant neoplasm of stomach | | | 3 | 6 | |
| Endocrine Cancers | | | | | |
| Malignant neoplasm of adrenal gland | | | | 50 | |
| Malignant neoplasm of islets of Langerhans | 9 | | | 27 | 9 |
| Malignant neoplasm of thyroid gland | | | 9 | | 3 |
| Genitourinary | | | | | |
| Malignant neoplasm of bladder | | | | 8 | |
| Malignant neoplasm of kidney | | | 7 | 9 | |
| Malignant neoplasm of testis | | | 28 | 9 | |
| Gynecologic | | | | | |
| Malignant neoplasm of fallopian tube | | | 33 | | |
| Malignant neoplasm of uterine cervix | | 4 | 17 | 21 | |
| Malignant neoplasm of myometrium | | | | 11 | |
| Malignant neoplasm of ovary | | 1 | 66 | 30 | 3 |
| Malignant neoplasm of uterus | | | 60 | 20 | |
| Malignant neoplasm of endometrium | | | 66 | 50 | 12 |
| Head & Neck | | | | | |
| Malignant neoplasm of major salivary gland | | | | 33 | |
| Malignant neoplasm of parotid gland | | | 50 | 27 | |
| Malignant neoplasm of tongue | | | | 14 | |
| Respiratory/Thoracic | | | | | |
| Malignant neoplasm of lung | | | 6 | 9 | |
| Malignant neoplasm of trachea | | | | 50 | |
| Skin | | | | | |
| Malignant neoplasm of skin | | | 4 | 4 | |

FGF-8 was over-expressed in endocrine cancer, including malignant neoplasms of the islets of Langerhans (Table 7).

FGF-17 was over-expressed in sarcoma, including malignant neoplasms of the soft tissues; and in gynecologic cancer, including malignant neoplasms of the uterine cervix and ovary (Table 7).

FGF-18 was over-expressed in lymphoma, including Hodgkin's lymphoma and extranodal lymphoma; in sarcoma, including malignant neoplasms of the bone and soft tissues; in breast cancer, including malignant neoplasms of the female breast and male breast; in digestive tract/gastrointestinal cancer, including malignant neoplasms of the ampulla of Vater, appendix, colon, esophagus, gallbladder, liver, pancreas, peritoneum, rectum, and stomach; in endocrine cancer, including malignant neoplasms of the thyroid gland; in genitourinary cancer, including malignant neoplasms of the kidney and testis; in gynecologic cancer, including malignant neoplasms of the fallopian tube, uterine cervix, ovary, uterus, and endometrium; in head and neck cancer, including malignant neoplasms of the parotid gland; in respiratory/thoracic cancer, including malignant neoplasms of the lung; and in skin cancer, including malignant neoplasms of the skin (Table 7).

FGF-9 was over-expressed in leukemia, including B-cell acute lymphoblastic leukemia; in lymphoma, including Burkitt's lymphoma and non-Hodgkin's lymphoma; in sarcoma, including malignant neoplasms of the bone and soft tissues; in neurologic cancer, including malignant neoplasms of the brain; in breast cancer, including malignant neoplasms of the female breast; in digestive tract/gastrointestinal cancer, including malignant neoplasms of the appendix, colon, esophagus, gallbladder, pancreas, peritoneum, rectum, small intestine, and stomach; in endocrine cancer, including malignant neoplasms of the adrenal gland and islets of Langerhans; in genitourinary cancer, including malignant neoplasms of the bladder, kidney, and testis; in gynecologic cancer, including malignant neoplasms of the uterine cervix, myometrium, ovary, uterus, and endometrium; in head and neck cancer, including malignant neoplasms of the salivary gland, parotid gland, and tongue; in respiratory/thoracic cancer, including malignant neoplasms of the lung and trachea; and in skin cancer, including malignant neoplasms of the skin (Table 7).

Table 6 demonstrates that FGF-8, FGF-17, FGF-18, FGF-9 and FGF-20 were often over-expressed in cancer this over-expression implicates active FGF signaling pathways in maintaining viability or proliferative capability of the affected tumors. Blocking these signaling pathways in the affected tumors, such as by blocking the interactions between FGF-8, FGF-17, FGF-9 and FGF-20 and their respective receptors, using decoy receptors, such as FGFR1-Fc, FGFR3-Fc and FGFR4-Fc fusion proteins, or any of their variants will reduce the viability and proliferative capacity of these tumors.

FGF-20 was over-expressed in digestive tract/gastrointestinal cancer, including malignant neoplasms of the colon; in endocrine cancer, including malignant neoplasms of the islets of Langerhans and thyroid gland; and in gynecologic cancer, including malignant neoplasms of the ovary and endometrium (Table 7).

EXAMPLE 25

Over-Expression of FGF-19, FGF-21, and FGF-23 in Cancerous Tissues Relative to Normal Tissues An analysis of the GeneLogic (Gaithersburg, Md.) database for the expression of FGF-19, FGF-21, or FGF-23 in cancer tissue types and in corresponding normal tissue types was performed essentially as described in Example 22. The Affymetrix U133 microarray chip contains probes corresponding to FGF-19, FGF-21, and FGF-23. The proportion of samples in the dataset of any given cancer type over-expressing FGF-19, FGF-21, or FGF-23 was calculated as a percentage of the total number of samples in that dataset and is shown in Table 9. Cancers which over-expressed FGF-19, FGF-21, or FGF-23 compared to corresponding normal tissues are therapeutic targets for the FGFR fusion proteins of the invention.

TABLE 8

FGF-19, FGF-21, and FGF-23 Over-expression in Malignant Tissues

| Cancer Type | Percent of Malignant Tissue Samples Over-expressing FGF-19, FGF-21, or FGF-23 | | |
|---|---|---|---|
| | FGF-19 | FGF-21 | FGF-23 |
| Sarcoma | | | |
| Malignant neoplasm of bone | 3 | | |
| Malignant neoplasm of soft tissues | 1 | | 1 |
| Neurologic | | | |
| Malignant neoplasm of brain | 3 | | |
| Digestive tract/Gastrointestinal | | | |
| Malignant neoplasm of colon | 5 | | |
| Malignant neoplasm of esophagus | | | 3 |
| Malignant neoplasm of gallbladder | 33 | | |
| Malignant neoplasm of liver | 11 | 32 | |
| Malignant neoplasm of pancreas | 22 | | |
| Malignant neoplasm of rectum | 7 | 1 | |
| Malignant neoplasm of small intestine | 7 | | |
| Malignant neoplasm of stomach | 1 | | |
| Endocrine Cancers | | | |
| Malignant neoplasm of thyroid gland | 3 | | |
| Genitourinary | | | |
| Malignant neoplasm of testis | 19 | | |
| Gynecologic | | | |
| Malignant neoplasm of uterine cervix | 8 | | |
| Malignant neoplasm of myometrium | | | 11 |
| Malignant neoplasm of ovary | 5 | | |
| Malignant neoplasm of endometrium | 12 | | |
| Malignant neoplasm of vulva | 5 | | |
| Head & Neck | | | |
| Malignant neoplasm of larynx | 5 | | |
| Respiratory/Thoracic | | | |
| Malignant neoplasm of lung | 5 | | |
| Skin | | | |
| Malignant neoplasm of skin | 9 | | 1 |

FGF-19 was over-expressed in sarcoma, including malignant neoplasms of the bone and soft tissues; in neurologic cancer, including malignant neoplasms of the brain; in digestive tract/gastrointestinal cancer, including malignant neoplasms of the colon, gallbladder, liver, pancreas, rectum, small intestine, and stomach; in endocrine cancer, including malignant neoplasms of the thyroid gland; in genitourinary cancer, including malignant neoplasms of the testis; in gynecologic cancer, including malignant neoplasms of the uterine cervix, ovary, endometrium, and vulva; in head and neck cancer, including malignant neoplasms of the larynx; in respiratory/thoracic cancer, including malignant neoplasms of the lung; and in skin cancer, including malignant neoplasms of the skin (Table 8).

FGF-21 was over-expressed in digestive tract/gastrointestinal cancer, including malignant neoplasms of the liver and rectum (Table 8).

FGF-23 was over-expressed in sarcoma, including malignant neoplasms of the soft tissues; in digestive tract/gastrointestinal cancer, including malignant neoplasms of the esophagus; in gynecologic cancer, including malignant neoplasms of the myometrium; and in skin cancer, including malignant neoplasms of the skin (Table 8).

Table 8 demonstrates that FGF-19, FGF-21 and FGF-23 were often over-expressed in cancer. This over-expression implicates active FGF signaling pathways in maintaining viability or proliferative capability of the affected tumors. Blocking these signaling pathways in the affected tumors such as by blocking the interactions between FGF-19, FGF-21 and FGF-23 and their respective receptors, using decoy receptors such as FGFR1-Fc, FGFR3-Fc and FGFR4-Fc fusion proteins or their variants will reduce the viability or proliferative capacity of these tumors.

EXAMPLE 26

Over-Expression of FGFR1 and Over-expression of FGF-1, FGF-2, FGF-4, FGF-5, FGF-8, FGF-9, FGF-17, FGF-19, FGF-20, and FGF-21 in Cancerous Tissues Relative to Normal Tissues FGF-1, FGF-2, FGF-4, FGF-5, FGF-8, FGF-9, FGF-17, FGF-19, FGF-20, and FGF-21 can induce proliferation in cancerous cells expressing FGFR1. An analysis of the GeneLogic (Gaithersburg, Md.) database for the expression of FGF-1, FGF-2, FGF-4, FGF-5, FGF-8, FGF-9, FGF-17, FGF-19, FGF-20, and FGF-21 in cancer tissue types and in corresponding normal tissue types was performed essentially as described in Example 22. The Affymetrix U133 microarray chip contains probes corresponding to FGFR1, FGF-1, FGF-2, FGF-4, FGF-5, FGF-8, FGF-9, FGF-17, FGF-19, FGF-20, and FGF-21. The proportion of samples in the dataset of any given cancer type over-expressing FGFR1, FGF-1, FGF-2, FGF-4, FGF-5, FGF-8, FGF-9, FGF-17, FGF-19, FGF-20, or FGF-21 was calculated as a percentage of the total number of samples in that dataset and is shown in Table 10. Cancers which over-expressed FGFR1, FGF-1, FGF-2, FGF-4, FGF-5, FGF-8, FGF-9, FGF-17, FGF-19, FGF-20, and FGF-21 compared to corresponding normal tissues are therapeutic targets for the FGFR fusion proteins of the invention.

TABLE 9

FGFR-1, FGF-1, FGF-2, FGF-4, FGF-8, FGF-9, FGF-17, FGF-19, FGF-20, and FGF-21 Over-expression in Malignant Tissues Percent of Malignant Tissue Samples Over-expressing FGFR1, FGF-1, FGF-2, FGF-4, FGF-5, FGF-8, FGF-9, FGF-17, FGF-19, FGF-20, or FGF-21

| Cancer Type | FGFR1 | FGF-1 | FGF-2 | FGF-4 | FGF-5 | FGF-8 | FGF-9 | FGF-17 | FGF-19 | FGF-20 | FGF-21 |
|---|---|---|---|---|---|---|---|---|---|---|---|
| Leukemia | | | | | | | | | | | |
| B-cell acute lymphoblastic leukemia | 100 | | | | | | 100 | | | | |
| Chronic myeloid leukemia | 75 | 25 | | | | | | | | | |
| Lymphoma | | | | | | | | | | | |
| Hodgkin's disease of lymph nodes | 6 | 20 | 6 | | | | | | | | |
| Malignant lymphoma of extranodal site | 12 | 12 | 3 | 3 | | | | | | | |
| Malignant lymphoma, non-Hodgkin's type | 16 | 10 | 11 | 6 | | | 1 | | | | |
| Myeloma | | | | | | | | | | | |
| Plasmacytoma | 50 | | 50 | | | | | | | | |
| Sarcoma | | | | | | | | | | | |
| Malignant neoplasm of bone | 83 | 29 | 29 | 3 | 6 | | 32 | | 3 | | |
| Malignant neoplasm of soft tissues | 37 | 25 | 42 | 4 | 18 | | 16 | 2 | 1 | | |
| Neurologic | | | | | | | | | | | |
| Malignant neoplasm of brain | 89 | 3 | 53 | 3 | | | 32 | | 3 | | |
| Breast | | | | | | | | | | | |
| Malignant neoplasm of female breast | 16 | 19 | 5 | 7 | | | 2 | | | | |
| Digestive tract/Gastrointestinal | | | | | | | | | | | |
| Malignant neoplasm of ampulla of Vater | 50 | | 50 | 25 | | | | | | | |
| Malignant neoplasm of appendix | 50 | | 50 | | | | 50 | | | | |
| Malignant neoplasm of colon | 30 | 11 | 12 | 7 | | | 7 | | 5 | 1 | |
| Malignant neoplasm of duodenum | 63 | | 18 | | | | | | | | |
| Malignant neoplasm of esophagus | 22 | 7 | 22 | 3 | | | 3 | | | | |

TABLE 9-continued

FGFR-1, FGF-1, FGF-2, FGF-4, FGF-8, FGF-9, FGF-17, FGF-19, FGF-20,
and FGF-21 Over-expression in Malignant Tissues Percent of Malignant Tissue Samples Over-expressing FGFR1,
FGF-1, FGF-2, FGF-4, FGF-5, FGF-8, FGF-9, FGF-17, FGF-19,
FGF-20, or FGF-21

| Cancer Type | FGFR1 | FGF-1 | FGF-2 | FGF-4 | FGF-5 | FGF-8 | FGF-9 | FGF-17 | FGF-19 | FGF-20 | FGF-21 |
|---|---|---|---|---|---|---|---|---|---|---|---|
| Malignant neoplasm of liver | 32 | 20 | 23 | 11 | 8 | | | | 11 | | 32 |
| Malignant neoplasm of pancreas | 11 | 30 | 53 | 8 | | | 2 | | 22 | | |
| Malignant neoplasm of the peritoneum | 35 | 7 | | 7 | 7 | | 35 | | | | |
| Malignant neoplasm of rectum | 26 | 5 | 8 | 3 | | | 5 | | 7 | | 1 |
| Malignant neoplasm of small intestine | 69 | 30 | 53 | | | | 23 | | 7 | | |
| Malignant neoplasm of stomach | 30 | 19 | 28 | 9 | | | 6 | | 1 | | |
| Endocrine Cancers | | | | | | | | | | | |
| Malignant neoplasm of adrenal gland | 50 | | 50 | | | | 50 | | | | |
| Malignant neoplasm of islets of Langerhans | 9 | 18 | 63 | 9 | | 9 | 27 | | | 9 | |
| Malignant neoplasm of thyroid gland | 43 | 22 | 30 | 7 | 1 | | | | 3 | 3 | |
| Genitourinary | | | | | | | | | | | |
| Malignant neoplasm of bladder | 8 | 8 | 8 | 4 | | | 8 | | | | |
| Malignant neoplasm of kidney | 77 | 2 | 48 | 6 | | | 9 | | | | |
| Malignant neoplasm of prostate | 11 | 8 | 5 | 4 | | | | | | | |
| Malignant neoplasm of testis | 80 | 28 | 52 | 42 | | | 9 | | 19 | | |
| Gynecologic | | | | | | | | | | | |
| Malignant neoplasm of uterine cervix | 26 | 17 | 8 | 13 | | | 21 | 4 | 8 | | |
| Malignant neoplasm of myometrium | 100 | 11 | 22 | 11 | | | 11 | | | | |
| Malignant neoplasm of ovary | 16 | 12 | 9 | 6 | 1 | | 30 | 1 | 5 | 3 | |
| Malignant neoplasm of uterus | 60 | | | | | | 20 | | | | |
| Malignant neoplasm of endometrium | 69 | 19 | 12 | 23 | 2 | | 50 | | 12 | 12 | |
| Malignant neoplasm of placenta | 100 | | 100 | | | | | | | | |
| Malignant neoplasm of vulva | 5 | 40 | 25 | 5 | | | | | 5 | | |
| Head & Neck | | | | | | | | | | | |
| Malignant neoplasm of larynx | 36 | 21 | 10 | 15 | | | | | 5 | | |
| Malignant neoplasm of major salivary gland | 66 | 33 | 66 | | | | 33 | | | | |
| Malignant neoplasm of parotid gland | 27 | 18 | 54 | | 9 | | 27 | | | | |
| Malignant neoplasm of tongue | 71 | 42 | 28 | 28 | | | 14 | | | | |
| Respiratory/Thoracic | | | | | | | | | | | |
| Malignant neoplasm of lung | 28 | 20 | 13 | 8 | 1 | | 9 | | 5 | | |
| Malignant neoplasm of thymus | 50 | | 50 | | | | | | | | |
| Malignant neoplasm of trachea | 100 | | 100 | | | | 50 | | | | |
| Skin | | | | | | | | | | | |
| Malignant neoplasm of skin | 22 | 27 | 19 | 3 | 6 | | 4 | | 9 | | |

FGFR1 and FGF-1 were both over-expressed in leukemia, including chronic myeloid leukemia; in lymphoma, including Hodgkin's lymphoma, non-Hodgkin's lymphoma, and extranodal lymphoma; in sarcoma, including malignant neoplasms of the bone and soft tissues; in neurologic cancer, including malignant neoplasms of the brain; in breast cancer, including malignant neoplasms of the female breast; in digestive tract/gastrointestinal cancer, including malignant neoplasms of the colon, esophagus, liver, pancreas, peritoneum, rectum, small intestine, and stomach; in endocrine cancer, including malignant neoplasms of the islets of Langerhans, and thyroid gland; in genitourinary cancer, including malignant neoplasms of the bladder, kidney, prostate, and testis; in gynecologic cancer, including malignant neoplasms of the uterine cervix, myometrium, ovary, endometrium, and vulva; in head and neck cancer, including malignant neoplasms of the larynx, salivary gland, parotid gland, and tongue; in respiratory/thoracic cancer, including malignant neoplasms of the lung; and in skin cancer, including malignant neoplasms of the skin (Table 9).

FGFR1 and FGF-2 were both over-expressed in lymphoma, including Hodgkin's lymphoma, non-Hodgkin's lymphoma, and extranodal lymphoma; in myeloma, including plasmacytoma; in sarcoma, including malignant neoplasms of the bone and soft tissues; in neurologic cancer, including malignant neoplasms of the brain; in breast cancer, including malignant neoplasms of the female breast; in digestive tract/gastrointestinal cancer, including malignant neoplasms of the ampulla of Vater, appendix, colon, duodenum, esophagus, liver, pancreas, rectum, small intestine, and stomach; in endocrine cancer, including malignant neoplasms of the adrenal gland, islets of Langerhans, and thyroid gland; in genitourinary cancer, including malignant neoplasms of the bladder, kidney, prostate, and testis; in gynecologic cancer, including malignant neoplasms of the uterine cervix, myometrium, ovary, endometrium, placenta, and vulva; in head and neck cancer, including malignant neoplasms of the larynx, salivary gland, parotid gland, and tongue; in respiratory/thoracic cancer, including malignant neoplasms of the lung, thymus, and trachea; and in skin cancer, including malignant neoplasms of the skin (Table 9).

FGFR1 and FGF-4 were both over-expressed in lymphoma, including non-Hodgkin's lymphoma, and extranodal lymphoma; in sarcoma, including malignant neoplasms of the bone and soft tissues; in neurologic cancer, including malignant neoplasms of the brain; in breast cancer, including malignant neoplasms of the female breast; in digestive tract/gastrointestinal cancer, including malignant neoplasms of the ampulla of Vater, colon, esophagus, liver, pancreas, peritoneum, rectum, and stomach; in endocrine cancer, including malignant neoplasms of the islets of Langerhans, and thyroid gland; in genitourinary cancer, including malignant neoplasms of the bladder, kidney, prostate, and testis; in gynecologic cancer, including malignant neoplasms of the uterine cervix, myometrium, ovary, endometrium, and vulva; in head and neck cancer, including malignant neoplasms of the larynx and tongue; in respiratory/thoracic cancer, including malignant neoplasms of the lung; and in skin cancer, including malignant neoplasms of the skin (Table 9).

FGFR1 and FGF-5 were both over-expressed in sarcoma, including malignant neoplasms of the bone and soft tissues; in digestive tract/gastrointestinal cancer, including malignant neoplasms of the liver and peritoneum; in endocrine cancer, including malignant neoplasms of the thyroid gland; in gynecologic cancer, including malignant neoplasms of the ovary and endometrium; in head and neck cancer, including malignant neoplasms of the parotid gland; in respiratory/thoracic cancer, including malignant neoplasms of the lung; and in skin cancer, including malignant neoplasms of the skin (Table 9).

FGFR1 and FGF-8 were both over-expressed in endocrine cancer, including malignant neoplasms of the islets of Langerhans (Table 9).

FGFR1 and FGF-9 were both over-expressed in leukemia, including B-cell acute lymphoblastic leukemia; in lymphoma, including non-Hodgkin's lymphoma; in sarcoma, including malignant neoplasms of the bone and soft tissues; in neurologic cancer, including malignant neoplasms of the brain; in breast cancer, including malignant neoplasms of the female breast; in digestive tract/gastrointestinal cancer, including malignant neoplasms of the appendix, colon, esophagus, pancreas, peritoneum, rectum, small intestine, and stomach; in endocrine cancer, including malignant neoplasms of the adrenal gland and islets of Langerhans; in genitourinary cancer, including malignant neoplasms of the bladder, kidney, and testis; in gynecologic cancer, including malignant neoplasms of the uterine cervix, myometrium, ovary, uterus, and endometrium; in head and neck cancer, including malignant neoplasms of the salivary gland, parotid gland, and tongue; in respiratory/thoracic cancer, including malignant neoplasms of the lung and trachea; and in skin cancer, including malignant neoplasms of the skin (Table 9).

FGFR1 and FGF-17 were both over-expressed in sarcoma, including malignant neoplasms of the soft tissues; and in gynecologic cancer, including malignant neoplasms of the uterine cervix and ovary (Table 9).

FGFR1 and FGF-19 were both over-expressed in sarcoma, including malignant neoplasms of the bone and soft tissues; in neurologic cancer, including malignant neoplasms of the brain; in digestive tract/gastrointestinal cancer, including malignant neoplasms of the colon, liver, pancreas, rectum, small intestine, and stomach; in endocrine cancer, including malignant neoplasms of the thyroid gland; in genitourinary cancer, including malignant neoplasms of the testis; in gynecologic cancer, including malignant neoplasms of the uterine cervix, ovary, endometrium, and vulva; in head and neck cancer, including malignant neoplasms of the larynx; in respiratory/thoracic cancer, including malignant neoplasms of the lung; and in skin cancer, including malignant neoplasms of the skin (Table 9).

FGFR1 and FGF-20 were both over-expressed in digestive tract/gastrointestinal cancer, including malignant neoplasms of the colon; in endocrine cancer, including malignant neoplasms of the islets of Langerhans, and thyroid gland; and in gynecologic cancer, including malignant neoplasms of the ovary and endometrium (Table 9).

FGFR1 and FGF-21 were both over-expressed in digestive tract/gastrointestinal cancer, including malignant neoplasms of the liver and rectum (Table 9).

Table 9 demonstrates that FGFR1 and any one or more of FGF-1, FGF-2, FGF-4, FGF-5, FGF-8, FGF-9, FGF-17, FGF-19, FGF-20 and FGF-21 were often over-expressed in cancer. This over-expression implicates active FGF signaling pathways in maintaining viability or proliferative capability of the affected tumors. Blocking these signaling pathways in the affected tumors, such as by blocking the interaction between FGF-1, FGF-2, FGF-4, FGF-5, FGF-8, FGF-0, FGF-17, FGF-19 and/or FGF-20 and their respective receptors and between FGFR1 and its binding ligands, using decoy receptors such as FGFR1-Fc, FGFR3-Fc, and FGFR4-Fc fusion proteins, or their variants will reduce the viability or proliferative capacity of these tumors.

EXAMPLE 27

Over-Expression of FGFR3 and Over-Expression of FGF-1, FGF-2, FGF-4, FGF-5, FGF-8, FGF-9, FGF-17, FGF-18, FGF-19, and FGF-20 in Cancerous Tissues Relative to Normal Tissues FGF-1, FGF-2, FGF-4, FGF-5, FGF-8, FGF-9, FGF-17, FGF-18, FGF-19, and FGF-20 can induce proliferation in cancerous cells expressing FGFR3. An analysis of the GeneLogic (Gaithersburg, Md.) database for the expression of FGF-1, FGF-2, FGF-4, FGF-5, FGF-8, FGF-9, FGF-17, FGF-18, FGF-19, and FGF-20 in cancer tissue types and in corresponding normal tissue types was performed essentially as described in Example 22. The Affymetrix U133 microarray chip contains probes corresponding to FGFR3, FGF-1, FGF-2, FGF-4, FGF-5, FGF-8, FGF-9, FGF-17, FGF-18, FGF-19, and FGF-20. The proportion of samples in the dataset of any given cancer type over-expressing FGFR3, FGF-1, FGF-2, FGF-4, FGF-5, FGF-8, FGF-9, FGF-17, FGF-18, FGF-19, and FGF-20 was calculated as a percentage of the total number of samples in that dataset and is shown in Table 11. Cancers which over-expressed FGFR3, FGF-1, FGF-2, FGF-4, FGF-5, FGF-8, FGF-9, FGF-17, FGF-18, FGF-19, and FGF-20 compared to corresponding normal tissues are therapeutic targets for the FGFR fusion proteins of the invention.

TABLE 10

FGFR-3, FGF-1, FGF-2, FGF-4, FGF-5, FGF-8, FGF-9, FGF-17, FGF-18,
FGF-19, and FGF-20 Over-expression in Malignant Tissues Percent of Malignant Tissue Samples Over-expressing FGFR3,
FGF-1, FGF-2, FGF-4, FGF-5, FGF-8, FGF-9, FGF-17, FGF-18,
FGF-19, or FGF-20

| Cancer Type | FGFR3 | FGF-1 | FGF-2 | FGF-4 | FGF-5 | FGF-8 | FGF-9 | FGF-17 | FGF-18 | FGF-19 | FGF-20 |
|---|---|---|---|---|---|---|---|---|---|---|---|
| Lymphoma | | | | | | | | | | | |
| Burkitt''s tumor of extranodal site | 7 | 100 | | | | | 1 | | | | |
| Sarcoma | | | | | | | | | | | |
| Malignant neoplasm of bone | 35 | 29 | 29 | 3 | 6 | | 32 | | 6 | 3 | |
| Malignant neoplasm of soft tissues | 15 | 25 | 42 | 4 | 18 | | 16 | 2 | 32 | 1 | |
| Neurologic | | | | | | | | | | | |
| Malignant neoplasm of brain | 21 | 3 | 53 | 3 | | | 32 | | | 3 | |
| Breast | | | | | | | | | | | |
| Malignant neoplasm of female breast | 24 | 19 | 5 | 7 | | | 2 | | 9 | | |
| Malignant neoplasm of male breast | 25 | 50 | | | 25 | | | | 25 | | |
| Digestive tract/Gastrointestinal | | | | | | | | | | | |
| Malignant neoplasm of ampulla of Vater | 25 | | 50 | 25 | | | | | 25 | | |
| Malignant neoplasm of colon | 17 | 11 | 12 | 7 | | | 7 | | 12 | 5 | 1 |
| Malignant neoplasm of duodenum | 18 | | 18 | | | | | | | | |
| Malignant neoplasm of esophagus | 18 | 7 | 22 | 3 | | | 3 | | 22 | | |
| Malignant neoplasm of gallbladder | 66 | 33 | | | | | 33 | | 66 | 33 | |
| Malignant neoplasm of liver | 55 | 20 | 23 | 11 | 8 | | | | 2 | 11 | |
| Malignant neoplasm of pancreas | 28 | 30 | 53 | 8 | | | 2 | | 22 | 22 | |
| Malignant neoplasm of rectum | 14 | 5 | 8 | 3 | | | 5 | | 21 | 7 | |
| Malignant neoplasm of small intestine | 30 | 30 | 53 | | | | 23 | | | 7 | |
| Malignant neoplasm of stomach | 14 | 19 | 28 | 9 | | | 6 | | 3 | 1 | |
| Endocrine Cancers | | | | | | | | | | | |
| Malignant neoplasm of islets of Langerhans | 45 | 18 | 63 | 9 | | 9 | 27 | | | | 9 |
| Malignant neoplasm of thyroid gland | 3 | 22 | 30 | 7 | 1 | | | | 9 | 3 | 3 |
| Genitourinary | | | | | | | | | | | |
| Malignant neoplasm of bladder | 56 | 8 | 8 | 4 | | | 8 | | | | |
| Malignant neoplasm of kidney | 5 | 2 | 48 | 6 | | | 9 | | 7 | | |
| Malignant neoplasm of prostate | 23 | 8 | 5 | 4 | | | | | | | |
| Malignant neoplasm of testis | 100 | 28 | 52 | 42 | | | 9 | | 28 | 19 | |
| Malignant neoplasm of ureter | 100 | 33 | | | | | | | | | |
| Gynecologic | | | | | | | | | | | |
| Malignant neoplasm of uterine cervix | 52 | 17 | 8 | 13 | | | 21 | 4 | 17 | 8 | |
| Malignant neoplasm of ovary | 13 | 12 | 9 | 6 | 1 | | 30 | 1 | 66 | 5 | 3 |
| Malignant neoplasm of uterus | 20 | | | | | | 20 | | 60 | | |
| Malignant neoplasm of endometrium | 16 | 19 | 12 | 23 | 2 | | 50 | | 66 | 12 | 12 |
| Malignant neoplasm of vulva | 5 | 40 | 25 | 5 | | | | | | 5 | |
| Head & Neck | | | | | | | | | | | |
| Malignant neoplasm of larynx | 26 | 21 | 10 | 15 | | | | | | 5 | |
| Malignant neoplasm of parotid gland | 18 | 18 | 54 | | 9 | | 27 | | 50 | | |
| Malignant neoplasm of tongue | 14 | 42 | 28 | 28 | | | 14 | | | | |
| Respiratory/Thoracic | | | | | | | | | | | |
| Malignant neoplasm of lung | 35 | 20 | 13 | 8 | 1 | | 9 | | 6 | 5 | |
| Skin | | | | | | | | | | | |
| Malignant neoplasm of skin | 16 | 27 | 19 | 3 | 6 | | 4 | | 4 | 9 | |

FGFR3 and FGF-1 were both over-expressed in lymphoma, including Burkitt's lymphoma; in sarcoma, including malignant neoplasms of the bone and soft tissues; in neurologic cancer, including malignant neoplasms of the brain; in breast cancer, including malignant neoplasms of the female breast and male breast; in digestive tract/gastrointestinal cancer, including malignant neoplasms of the colon, esophagus, gallbladder, liver, pancreas, rectum, small intestine, and stomach; in endocrine cancer, including malignant neoplasms of the islets of Langerhans and thyroid gland; in genitourinary cancer, including malignant neoplasms of the bladder, kidney, prostate, testis, and ureter; in gynecologic cancer, including malignant neoplasms of the uterine cervix, ovary, endometrium, and vulva; in head and neck cancer, including malignant neoplasms of the larynx, parotid gland, and tongue; in respiratory/thoracic cancer, including malignant neoplasms of the lung; and in skin cancer, including malignant neoplasms of the skin (Table 10).

FGFR3 and FGF-2 were both over-expressed in sarcoma, including malignant neoplasms of the bone and soft tissues; in neurologic cancer, including malignant neoplasms of the brain; in breast cancer, including malignant neoplasms of the female breast; in digestive tract/gastrointestinal cancer, including malignant neoplasms of the ampulla of Vater, colon, duodenum, esophagus, liver, pancreas, rectum, small intestine, and stomach; in endocrine cancer, including malignant neoplasms of the islets of Langerhans and thyroid gland; in genitourinary cancer, including malignant neoplasms of the bladder, kidney, prostate, and testis; in gynecologic cancer, including malignant neoplasms of the uterine cervix, ovary, endometrium, and vulva; in head and neck cancer, including malignant neoplasms of the larynx, parotid gland, and tongue; in respiratory/thoracic cancer, including malignant neoplasms of the lung; and in skin cancer, including malignant neoplasms of the skin (Table 10).

FGFR3 and FGF-4 were both over-expressed in sarcoma, including malignant neoplasms of the bone and soft tissues; in neurologic cancer, including malignant neoplasms of the brain; in breast cancer, including malignant neoplasms of the female breast; in digestive tract/gastrointestinal cancer, including malignant neoplasms of the ampulla of Vater, colon, esophagus, liver, pancreas, rectum, and stomach; in endocrine cancer, including malignant neoplasms of the islets of Langerhans and thyroid gland; in genitourinary cancer, including malignant neoplasms of the bladder, kidney, prostate, and testis; in gynecologic cancer, including malignant neoplasms of the uterine cervix, ovary, endometrium, and vulva; in head and neck cancer, including malignant neoplasms of the larynx and tongue; in respiratory/thoracic cancer, including malignant neoplasms of the lung; and in skin cancer, including malignant neoplasms of the skin (Table 10).

FGFR3 and FGF-5 were both over-expressed in sarcoma, including malignant neoplasms of the bone and soft tissues; in breast cancer, including malignant neoplasms of the male breast; in digestive tract/gastrointestinal cancer, including malignant neoplasms of the liver; in endocrine cancer, including malignant neoplasms of the thyroid gland; in gynecologic cancer, including malignant neoplasms of the ovary and endometrium; in head and neck cancer, including malignant neoplasms of the parotid gland; in respiratory/thoracic cancer, including malignant neoplasms of the lung; and in skin cancer, including malignant neoplasms of the skin (Table 10).

FGFR3 and FGF-8 were both over-expressed in endocrine cancer, including malignant neoplasms of the islets of Langerhans (Table 10).

FGFR3 and FGF-9 were both over-expressed in lymphoma, including Burkitt's lymphoma; in sarcoma, including malignant neoplasms of the bone and soft tissues; in neurologic cancer, including malignant neoplasms of the brain; in breast cancer, including malignant neoplasms of the female breast; in digestive tract/gastrointestinal cancer, including malignant neoplasms of the colon, esophagus, gallbladder, pancreas, rectum, small intestine, and stomach; in endocrine cancer, including malignant neoplasms of the islets of Langerhans; in genitourinary cancer, including malignant neoplasms of the bladder, kidney, and testis; in gynecologic cancer, including malignant neoplasms of the uterine cervix, ovary, uterus, and endometrium; in head and neck cancer, including malignant neoplasms of the parotid gland and tongue; in respiratory/thoracic cancer, including malignant neoplasms of the lung; and in skin cancer, including malignant neoplasms of the skin (Table 10).

FGFR3 and FGF-17 were both over-expressed in sarcoma, including malignant neoplasms of the soft tissues, and in gynecologic cancer, including malignant neoplasms of the uterine cervix and ovary (Table 10).

FGFR3 and FGF-18 were both over-expressed in sarcoma, including malignant neoplasms of the bone and soft tissues; in breast cancer, including malignant neoplasms of the female breast and male breast; in digestive tract/gastrointestinal cancer, including malignant neoplasms of the ampulla of Vater, colon, esophagus, gallbladder, liver, pancreas, rectum, and stomach; in endocrine cancer, including malignant neoplasms of the thyroid gland; in genitourinary cancer, including malignant neoplasms of the kidney and testis; in gynecologic cancer, including malignant neoplasms of the uterine cervix, ovary, uterus, and endometrium; in head and neck cancer, including malignant neoplasms of the parotid gland; in respiratory/thoracic cancer, including malignant neoplasms of the lung; and in skin cancer, including malignant neoplasms of the skin (Table 10).

FGFR3 and FGF-19 were both over-expressed in sarcoma, including malignant neoplasms of the bone and soft tissues; in neurologic cancer, including malignant neoplasms of the brain; in digestive tract/gastrointestinal cancer, including malignant neoplasms of the colon; gallbladder, liver, pancreas, rectum, small intestine, and stomach; in endocrine cancer, including malignant neoplasms of the thyroid gland; in genitourinary cancer, including malignant neoplasms of the testis; in gynecologic cancer, including malignant neoplasms of the uterine cervix, ovary, endometrium, and vulva; in head and neck cancer, including malignant neoplasms of the larynx; in respiratory/thoracic cancer, including malignant neoplasms of the lung; and in skin cancer, including malignant neoplasms of the skin (Table 10).

FGFR3 and FGF-20 were both over-expressed in digestive tract/gastrointestinal cancer, including malignant neoplasms of the colon; in endocrine cancer, including malignant neoplasms of the islets of Langerhans and thyroid gland; and in gynecologic cancer, including malignant neoplasms of the ovary and endometrium (Table 10).

Table 11 demonstrates that FGFR3 and any one or more of FGF-1, FGF-2, FGF-4, FGF-5, FGF-8, FGF-9, FGF-17, FGF-18, FGF-19 and FGF-20 were often over-expressed in cancer. This over-expression implicates active FGF signaling pathways in maintaining viability or proliferative capacity of the affected tumors. Blocking these signaling pathways in the affected tumors, such as by blocking the interactions between FGF-1, FGF-2, FGP-4, FGF-5, FGF-8, FGF-9, FGF-17, FGF-18, FGF-19 and/or FGF-20 and their respective receptors and between FGFR3 and its binding ligands with decoy receptors such as FGFR1-Fc, FGFR3-Fc and FGFR4-Fc fusion proteins, or their variants will reduce the viability or proliferative capacity of these tumors.

EXAMPLE 28

Over-Expression of FGFR4 and Over-Expression of FGF-1, FGF-2, FGF-4, FGF-8, FGF-9, FGF-17, FGF-18, FGF-19, FGF-20, FGF-21, and FGF-23 in Cancerous Tissues Relative to Normal Tissues FGF-1, FGF-2, FGF-4, FGF-8, FGF-9, FGF-17, FGF-18, FGF-19, FGF-20, FGF-21, and FGF-23 can induce prolifera tion in cancerous cells expressing FGFR4. An analysis of the GeneLogic (Gaithersburg, Md.) database for the expression of FGF-1, FGF-2, FGF-4, FGF-5, FGF-8, FGF-9, FGF-17, FGF-18, FGF-19, and FGF-20 in cancer tissue types and in corresponding normal tissue types was performed essentially as described in Example 22. The Affymetrix U133 microarray chip contains probes corresponding to FGFR3, FGF-1, FGF-2, FGF-4, FGF-5, FGF-8, FGF-9, FGF-17, FGF-18, FGF-19, and FGF-20. The proportion of samples in the dataset of any given cancer type over-expressing FGFR3, FGF-1, FGF-2, FGF-4, FGF-5, FGF-8, FGF-9, FGF-17, FGF-18, FGF-19, and FGF-20 was calculated as a percentage of the total number of samples in that dataset and is shown in Table 11. Cancers which over-expressed FGFR3, FGF-1, FGF-2, FGF-4, FGF-5, FGF-8, FGF-9, FGF-17, FGF-18, FGF-19, and FGF-20 compared to corresponding normal tissues are therapeutic targets for the FGFR fusion proteins of the invention.

TABLE 11

FGFR-4, FGF-1, FGF-2, FGF-4, FGF-8, FGF-9, FGF-17, FGF-18, FGF-19, FGF-20, FGF-21, and FGF-23 Over-expression in Malignant Tissues

| Cancer Type | Percent of Malignant Tissue Samples Over-expressing FGFR4, FGF-1, FGF-2, FGF-4, FGF-8, FGF-9, FGF-17, FGF-18, FGF-19, FGF-20, FGF-21, or FGF-23 | | | | | | | | | | | |
|---|---|---|---|---|---|---|---|---|---|---|---|---|
| | FGFR4 | FGF-1 | FGF-2 | FGF-4 | FGF-8 | FGF-9 | FGF-17 | FGF-18 | FGF-19 | FGF-20 | FGF-21 | FGF-23 |
| Lymphoma | | | | | | | | | | | | |
| Malignant lymphoma, non-Hodgkin's type | 1 | 10 | 11 | 6 | | 1 | | 1 | | | | |
| Sarcoma | | | | | | | | | | | | |
| Malignant neoplasm of bone | 3 | 29 | 29 | 3 | | 32 | | 6 | 3 | | | |
| Malignant neoplasm of heart | 100 | | 100 | 100 | | | | | | | | |
| Malignant neoplasm of soft tissues | 7 | 25 | 42 | 4 | | 16 | 2 | 32 | 1 | | | 1 |
| Breast | | | | | | | | | | | | |
| Malignant neoplasm of female breast | 13 | 19 | 5 | 7 | | 2 | | 9 | | | | |
| Digestive tract/Gastrointestinal | | | | | | | | | | | | |
| Malignant neoplasm of colon | 45 | 11 | 12 | 7 | | 7 | | 12 | 5 | 1 | | |
| Malignant neoplasm of duodenum | 36 | | 18 | | | | | | | | | |
| Malignant neoplasm of esophagus | 55 | 7 | 22 | 3 | | 3 | | 22 | | | | 3 |
| Malignant neoplasm of gallbladder | 33 | 33 | | | | 33 | | 66 | 33 | | | |
| Malignant neoplasm of liver | 52 | 20 | 23 | 11 | | | | 2 | 11 | 32 | | |
| Malignant neoplasm of pancreas | 14 | 30 | 53 | 8 | | 2 | | 22 | 22 | | | |
| Malignant neoplasm of rectum | 59 | 5 | 8 | 3 | | 5 | | 21 | 7 | 1 | | |
| Malignant neoplasm of small intestine | 7 | 30 | 53 | | | 23 | | | 7 | | | |
| Malignant neoplasm of stomach | 28 | 19 | 28 | 9 | | 6 | | 3 | 1 | | | |
| Endocrine Cancers | | | | | | | | | | | | |
| Malignant neoplasm of adrenal gland | 100 | | 50 | | | 50 | | | | | | |
| Malignant neoplasm of islets of Langerhans | 45 | 18 | 63 | 9 | 9 | 27 | | | 9 | | | |
| Genitourinary | | | | | | | | | | | | |
| Malignant neoplasm of kidney | 27 | 2 | 48 | 6 | | 9 | | 7 | | | | |
| Malignant neoplasm of testis | 38 | 28 | 52 | 42 | | 9 | | 28 | 19 | | | |
| Gynecologic | | | | | | | | | | | | |
| Malignant neoplasm of ovary | 6 | 12 | 9 | 6 | | 30 | 1 | 66 | 5 | 3 | | |
| Malignant neoplasm of endometrium | 7 | 19 | 12 | 23 | | 50 | | 66 | 12 | 12 | | |
| Head & Neck | | | | | | | | | | | | |
| Malignant neoplasm of parotid gland | 9 | 18 | 54 | | | 27 | | 50 | | | | |
| Respiratory/Thoracic | | | | | | | | | | | | |
| Malignant neoplasm of lung | 4 | 20 | 13 | 8 | | 9 | | 6 | 5 | | | |
| Skin | | | | | | | | | | | | |
| Malignant neoplasm of skin | 1 | 27 | 19 | 3 | | 4 | | 4 | 9 | | | 1 |

FGFR4 and FGF-1 were both over-expressed in lymphoma, including non-Hodgkin's lymphoma; in sarcoma, including malignant neoplasms of the bone and soft tissues; in breast cancer, including malignant neoplasms of the female breast; in digestive tract/gastrointestinal cancer, including malignant neoplasms of the colon, esophagus, gallbladder, liver, pancreas, rectum, small intestine, and stomach; in endocrine cancer, including malignant neoplasms of the islets of Langerhans; in genitourinary cancer, including malignant neoplasms of the kidney and testis; in gynecologic cancer, including malignant neoplasms of the ovary and endometrium; in head and neck cancer, including malignant neoplasms of the parotid gland; in respiratory/thoracic cancer, including malignant neoplasms of the lung; and in skin cancer, including malignant neoplasms of the skin (Table 11).

FGFR4 and FGF-2 were both over-expressed in lymphoma, including non-Hodgkin's lymphoma; in sarcoma, including malignant neoplasms of the bone, heart, and soft tissues; in breast cancer, including malignant neoplasms of the female breast; in digestive tract/gastrointestinal cancer, including malignant neoplasms of the colon, duodenum, esophagus, liver, pancreas, rectum, small intestine, and stomach; in endocrine cancer, including malignant neoplasms of the adrenal gland and islets of Langerhans; in genitourinary cancer, including malignant neoplasms of the kidney and testis; in gynecologic cancer, including malignant neoplasms of the ovary and endometrium; in head and neck cancer, including malignant neoplasms of the parotid gland; in respiratory/thoracic cancer, including malignant neoplasms of the lung; and in skin cancer, including malignant neoplasms of the skin (Table 11).

FGFR4 and FGF-4 were both over-expressed in lymphoma, including non-Hodgkin's lymphoma; in sarcoma, including malignant neoplasms of the bone, heart, and soft tissues; in breast cancer, including malignant neoplasms of the female breast; in digestive tract/gastrointestinal cancer, including malignant neoplasms of the colon; esophagus, liver, pancreas, rectum, and stomach; in endocrine cancer, including malignant neoplasms of the islets of Langerhans; in genitourinary cancer, including malignant neoplasms of the kidney and testis; in gynecologic cancer, including malignant neoplasms of the ovary and endometrium; in respiratory/thoracic cancer, including malignant neoplasms of the lung; and in skin cancer, including malignant neoplasms of the skin (Table 11).

FGFR4 and FGF-8 were both over-expressed in endocrine cancer, including malignant neoplasms of the islets of Langerhans (Table 12).

FGFR4 and FGF-9 were both over-expressed in lymphoma, including non-Hodgkin's lymphoma; in sarcoma, including malignant neoplasms of the bone and soft tissues; in breast cancer, including malignant neoplasms of the female breast; in digestive tract/gastrointestinal cancer, including malignant neoplasms of the colon, esophagus, gallbladder, pancreas, rectum, small intestine, and stomach; in endocrine cancer, including malignant neoplasms of the adrenal gland and islets of Langerhans; in genitourinary cancer, including malignant neoplasms of the kidney and testis; in gynecologic cancer, including malignant neoplasms of the ovary and endometrium; in head and neck cancer, including malignant neoplasms of the parotid gland; in respiratory/thoracic cancer, including malignant neoplasms of the lung; and in skin cancer, including malignant neoplasms of the skin (Table 11).

FGFR4 and FGF-17 were both over-expressed in sarcoma, including malignant neoplasms of the soft tissues; and in gynecologic cancer, including malignant neoplasms of the ovary (Table 11).

FGFR4 and FGF-18 were both over-expressed in lymphoma, including non-Hodgkin's lymphoma; in sarcoma, including malignant neoplasms of the bone and soft tissues; in breast cancer, including malignant neoplasms of the female breast; in digestive tract/gastrointestinal cancer, including malignant neoplasms of the colon, esophagus, gallbladder, liver, pancreas, rectum, and stomach; in genitourinary cancer, including malignant neoplasms of the kidney and testis; in gynecologic cancer, including malignant neoplasms of the ovary and endometrium; in head and neck cancer, including malignant neoplasms of the parotid gland; in respiratory/thoracic cancer, including malignant neoplasms of the lung; and in skin cancer, including malignant neoplasms of the skin (Table 11).

FGFR4 and FGF-19 were both over-expressed in sarcoma, including malignant neoplasms of the bone and soft tissues; in digestive tract/gastrointestinal cancer, including malignant neoplasms of the colon, gallbladder, liver, pancreas, rectum, small intestine, and stomach; in genitourinary cancer, including malignant neoplasms of the testis; in gynecologic cancer, including malignant neoplasms of the ovary and endometrium; in respiratory/thoracic cancer, including malignant neoplasms of the lung; and in skin cancer, including malignant neoplasms of the skin (Table 11).

FGFR4 and FGF-20 were both over-expressed in digestive tract/gastrointestinal cancer, including malignant neoplasms of the colon; in endocrine cancer, including malignant neoplasms of the islets of Langerhans; and in gynecologic cancer, including malignant neoplasms of the ovary and endometrium (Table 11).

FGFR4 and FGF-21 were both over-expressed in digestive tract/gastrointestinal cancer, including malignant neoplasms of the liver and rectum (Table 11).

FGFR4 and FGF-23 were both over-expressed in sarcoma, including malignant neoplasms of the soft tissues; in digestive tract/gastrointestinal cancer, including malignant neoplasms of the esophagus; and in skin cancer, including malignant neoplasms of the skin (Table 11).

This analysis demonstrated that FGFR4, FGF-1, FGF-2, FGF-4, FGF-5, FGF-8, FGF-9, FGF-17, FGF-18, FGF-19, FGF-20, FGF-21 and FGF-23 are commonly over-expressed in cancer. This over-expression implicates active FGF signaling pathways in maintaining viability and/or proliferative capability of the affected tumors. Blocking these FGFR signaling pathways in the affected tumors, such as with FGFR1-Fc, FGFR3-Fc, or FGFR4-Fc fusion proteins, will reduce the viability and/or proliferative capacity of these tumors.

Table 11 demonstrates that FGFR4 and any of FGF-1, FGF-2, FGF-4, FGF-5, FGF-8, FGF-9, FGF, FGF-17, FGF-18, FGF-19, FGF-20, FGF-21 and FGF-23 were often over-expressed in cancer. This over-expression implicates active FGF signaling pathways in maintaining viability or proliferative capability of the affected tumors. blocking these signaling pathways in the affected tumors, such as by blocking the interactions between FGF-1, FGF-2, FGF-4, FGF-8, FGF-9, FGF-17, FGF-18, FGF-19, FGF-20 and FGF-23; and between FGFR4 and its binding ligands with decoy receptors such as FGFR1-Fc, FGFR3-Fc and FGFR4-Fc fusion proteins, or their variants, will reduce the viability or proliferative capacity of these tumors.

INDUSTRIAL APPLICABILITY

The FGFR fusion proteins and the polynucleotide molecules that encode them are useful in treating proliferative diseases and diseases involving angiogenesis, including cancer. They can be used to diagnose, prevent, and treat these diseases.

SEQUENCE LISTING (308 sequences)

SEQ ID NO: 1 - DNA, 1122 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggag

SEQ ID NO: 2 - DNA, 855 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggag

SEQ ID NO: 3 - DNA, 1128 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggag

SEQ ID NO: 4 - DNA, 1824 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagggatccgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 5 - DNA, 1818 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 6 - DNA, 1806 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 7 - DNA, 1794 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 8 - DNA, 1791 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 9 - DNA, 1776 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 10 - DNA, 1761 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 11 - DNA, 1812 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagagggtgatgacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 12 - DNA, 1818 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggatggcagtgatgacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 13 - DNA, 1818 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgaacacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 14 - DNA, 1818 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggggggcagtgatgacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 15 - DNA, 1818 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggatggcagtgaacacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 16 - DNA, 1551 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 17 - DNA, 1539 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 18 - DNA, 1527 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 19 - DNA, 1524 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 20 - DNA, 1509 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 21 - DNA, 1545 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagagggtgatgacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 22 - DNA, 1551 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggatggcagtgatgacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 23 - DNA, 1551 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgaacacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 24 - DNA, 1551 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggggggcagtgatgacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 25 - DNA, 1551 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggggggcagtgaacacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 26 - DNA, 1824 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 27 - DNA, 1812 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 28 - DNA, 1800 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 29 - DNA, 1797 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 30 - DNA, 1782 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 31 - DNA, 1818 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagagggtgatgacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 32 - DNA, 1824 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggatggcagtgatgacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 33 - DNA, 1824 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgaacacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 34 - DNA, 1824 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggggggcagtgatgacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 35 - DNA, 1824 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggatggcagtgaacacctcgcccctgtacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 36 - DNA, 1110 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgccc

SEQ ID NO: 37 - DNA, 1098 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtg

SEQ ID NO: 38 - DNA, 1095 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggca

SEQ ID NO: 39 - DNA, 1080 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctg

SEQ ID NO: 40 - DNA, 1065 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgacc

SEQ ID NO: 41 - DNA, 1116 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagagggtgatgacctcgcccctgtacctggag

SEQ ID NO: 42 - DNA, 1122 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggatggcagtgatgacctcgcccctgtacctggag

SEQ ID NO: 43 - DNA, 1122 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgaacacctcgcccctgtacctggag

SEQ ID NO: 44 - DNA, 1122 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggggggcagtgatgacctcgcccctgtacctggag

SEQ ID NO: 45 - DNA, 1122 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggatggcagtgaacacctcgcccctgtacctggag

SEQ ID NO: 46 - DNA, 843 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgccc

SEQ ID NO: 47 - DNA, 831 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtg

SEQ ID NO: 48 - DNA, 828 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggca

SEQ ID NO: 49 - DNA, 813 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctg

SEQ ID NO: 50 - DNA, 849 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagagggtgatgacctcgcccctgtacctggag

SEQ ID NO: 51 - DNA, 855 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggatggcagtgatgacctcgcccctgtacctggag

SEQ ID NO: 52 - DNA, 855 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgaacacctcgcccctgtacctggag

SEQ ID NO: 53 - DNA, 855 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggggggcagtgatgacctcgcccctgtacctggag

SEQ ID NO: 54 - DNA, 855 bp, Homo sapiens
atgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggggggcagtgaacacctcgcccctgtacctggag

SEQ ID NO: 55 - DNA, 1116 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgccc

SEQ ID NO: 56 - DNA, 1104 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtg

SEQ ID NO: 57 - DNA, 1101 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggca

SEQ ID NO: 58 - DNA, 1086 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctg

SEQ ID NO: 59 - DNA, 1122 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagagggtgatgacctcgcccctgtacctggag

SEQ ID NO: 60 - DNA, 1128 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggatggcagtgatgacctcgcccctgtacctggag

SEQ ID NO: 61 - DNA, 1128 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgaacacctcgcccctgtacctggag

SEQ ID NO: 62 - DNA, 1128 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggggggcagtgatgacctcgcccctgtacctggag

SEQ ID NO: 63 - DNA, 1128 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctccggaagtgacaccacctacttctccgtcaatgtttcagatgctctcccctcctcggaggatgatgatgatgatgatgactcctcttcagaggagaaagaaacagataacaccaaaccaaacagaatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggatggcagtgaacacctcgcccctgtacctggag

SEQ ID NO: 64 - DNA, 1107 bp, Homo sapiens
atgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggac

SEQ ID NO: 65 - DNA, 1809 bp, Homo sapiens
atgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacggatccgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaa

SEQ ID NO: 66 - DNA, 1803 bp, Homo sapiens
atgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaa

SEQ ID NO: 67 - DNA, 477 bp, Homo sapiens
atggagagcgtggtgccctcggaccgcggcacatacacctgcctggtagagaacgctgtgggcagcatccgttataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggac

SEQ ID NO: 68 - DNA, 1107 bp, Homo sapiens
atgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacctctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggac

SEQ ID NO: 69 - DNA, 1107 bp, Homo sapiens; identical to SEQ ID NO: 64

SEQ ID NO: 70 - DNA, 1107 bp, Homo sapiens
atgcggctgctgctggccctgttggggatcctgctgagtgtgcctgggcctccagtcttgtccctggaggcctctgaggaagtggagcttgagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacctctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggac

SEQ ID NO: 71 - DNA, 1788 bp, Homo sapiens
atgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 72 - DNA, 1773 bp, Homo sapiens
atgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 73 - DNA, 1758 bp, Homo sapiens
atgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 74 - DNA, 1752 bp, Homo sapiens
atgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 75 - DNA, 1749 bp, Homo sapiens
atgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 76 - DNA, 57 bp, Homo sapiens
atgtggagctggaagtgcctcctcttctgggctgtgctggtcacagccacactctgc

SEQ ID NO: 77 - DNA, 57 bp, Homo sapiens
atgcggctgctgctggccctgttgggggtcctgctgagtgtgcctgggcctccagtc

SEQ ID NO: 78 - DNA, 63 bp, Homo sapiens
atgcggctgctgctggccctgttggggatcctgctgagtgtgcctgggcctccagtcttgtcc

SEQ ID NO: 79 - DNA, 6 bp, Artificial Sequence
  Description of Artificial Sequence: Synthetic linker sequence
ggatcc

SEQ ID NO: 80 - DNA, 696 bp, Homo sapiens
gagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 81 - DNA, 684 bp, Homo sapiens
gagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 82 - DNA, 687 bp, Homo sapiens
gtcgtggagcggtcccctcaccgccccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgg

SEQ ID NO: 83 - DNA, 1125 bp, Homo sapiens
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggc

SEQ ID NO: 84 - DNA, 930 bp, Homo sapiens
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaag

SEQ ID NO: 85 - DNA, 1827 bp, Homo sapiens
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcggatccgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 86 - DNA, 1821 bp, Homo sapiens
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 87 - DNA, 1809 bp, Homo sapiens
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 88 - DNA, 1797 bp, Homo sapiens
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 89 - DNA, 1794 bp, Homo sapiens
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 90 - DNA, 1779 bp, Homo sapiens
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 91 - DNA, 1761 bp, Homo sapiens
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 92 - protein, 374 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLE

SEQ ID NO: 93 - protein, 285 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLE

SEQ ID NO: 94 - protein, 376 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLE

SEQ ID NO: 95 - protein, 608 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 606 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 602 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 98 - protein, 598 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - protein, 597 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 592 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - protein, 587 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 604 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERVMTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 103 - protein, 606 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERMAVMTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 606 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERMAVNTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 105 - protein, 606 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERGAVMTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 106 - protein, 606 aa, Homo sapiens; identical to SEQ ID NO: 104

SEQ ID NO: 107 - protein, 517 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 108 - protein, 513 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 109 - protein, 509 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 110 - protein, 508 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 111 - protein, 503 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - protein, 515 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERVMTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - protein, 517 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERMAVMTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 114 - protein, 517 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVNTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 115 - protein, 517 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERGAVMTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 116 - protein, 517 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERMAVNTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 117 - protein, 608 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - protein, 604 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 119 - protein, 600 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - protein, 599 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 121 - protein, 594 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - protein, 606 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERVMTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 123 - protein, 608 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERMAVMTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - protein, 608 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVNTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - protein, 608 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERGAVMTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - protein, 608 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERMAVNTSPLYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 127 - protein, 370 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSP

SEQ ID NO: 128 - protein, 366 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAV

SEQ ID NO: 129 - protein, 365 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPA

SEQ ID NO: 130 - protein, 360 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEAL

SEQ ID NO: 131 - protein, 355 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLT

SEQ ID NO: 132 - protein, 372 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERVMTSPLYLE

SEQ ID NO: 133 - protein, 374 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERMAVMTSPLYLE

SEQ ID NO: 134 - protein, 374 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERMAVNTSPLYLE

SEQ ID NO: 135 - protein, 374 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERGAVMTSPLYLE

SEQ ID NO: 136 - protein, 374 aa, Homo sapiens; identical to SEQ ID NO: 134

SEQ ID NO: 137 - protein, 281 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSP

SEQ ID NO: 138 - protein, 277 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAV

SEQ ID NO: 139 - protein, 276 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPA

SEQ ID NO: 140 - protein, 271 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEAL

SEQ ID NO: 141 - protein, 283 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERVMTSPLYLE

SEQ ID NO: 142 - protein, 285 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERMAVMTSPLYLE

SEQ ID NO: 143 - protein, 285 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVNTSPLYLE

SEQ ID NO: 144 - protein, 285 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERGAVMTSPLYLE

SEQ ID NO: 145 - protein, 285 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERMAVNTSPLYLE

SEQ ID NO: 146 - protein, 372 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSP

SEQ ID NO: 147 - protein, 368 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAV

SEQ ID NO: 148 - protein, 367 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPA

SEQ ID NO: 149 - protein, 362 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEAL

SEQ ID NO: 150 - protein, 374 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERVMTSPLYLE

SEQ ID NO: 151 - protein, 376 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERMAVMTSPLYLE

SEQ ID NO: 152 - protein, 376 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVNTSPLYLE

SEQ ID NO: 153 - protein, 376 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERGAVMTSPLYLE

SEQ ID NO: 154 - protein, 376 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERMAVNTSPLYLE

SEQ ID NO: 155 - protein, 369 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTD

SEQ ID NO: 156 - protein, 603 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 157 - protein, 601 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 158 - protein, 159 aa, Homo sapiens
MESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTD

SEQ ID NO: 159 - protein, 369 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDLSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTD

SEQ ID NO: 160 - protein, 369 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGAVGFPYVQVLKTADINSSEVEVLYLRNVSAEDAGEYTCLAGNSIGLSYQSAWLTVLPEEDPTWTAAAPEARYTD

SEQ ID NO: 161 - protein, 369 aa, Homo sapiens
MRLLLALLGILLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDLSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTD

SEQ ID NO: 162 - protein, 596 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - protein, 591 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 164 - protein, 586 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 165 - protein, 584 aa, Homo sapiens [sequence omitted]

SEQ ID NO: 166 - protein, 583 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 167 - protein, 19 aa, Homo sapiens
MWSWKCLLFWAVLVTATLC

SEQ ID NO: 168 - protein, 19 aa, Homo sapiens
MRLLLALLGVLLSVPGPPV

SEQ ID NO: 169 - protein, 21 aa, Homo sapiens
MRLLLALLGILLSVPGPPVLS

SEQ ID NO: 170 - protein, 2 aa, Artificial Sequence
  Description of Artificial Sequence: Synthetic linker sequence
GS

SEQ ID NO: 171 - protein, 232 aa, Homo sapiens
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 172 - protein, 228 aa, Homo sapiens
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 173 - protein, 229 aa, Homo sapiens
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 174 - protein, 375 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAG

SEQ ID NO: 175 - protein, 310 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLK

SEQ ID NO: 176 - protein, 609 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 177 - protein, 607 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 178 - protein, 603 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 179 - protein, 599 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - protein, 598 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 181 - protein, 593 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 182 - protein, 587 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 183 - DNA, 1122 bp, Homo sapiens; identical to SEQ ID NO: 1

SEQ ID NO: 184 - DNA, 1818 bp, Homo sapiens; identical to SEQ ID NO: 5

SEQ ID NO: 185 - DNA, 1806 bp, Homo sapiens; identical to SEQ ID NO: 6

SEQ ID NO: 186 - DNA, 1794 bp, Homo sapiens; identical to SEQ ID NO: 7

SEQ ID NO: 187 - DNA, 1791 bp, Homo sapiens; identical to SEQ ID NO: 8

SEQ ID NO: 188 - DNA, 1776 bp, Homo sapiens; identical to SEQ ID NO: 9

SEQ ID NO: 189 - DNA, 1761 bp, Homo sapiens; identical to SEQ ID NO: 10

SEQ ID NO: 190 - DNA, 1125 bp, Homo sapiens; identical to SEQ ID NO: 83

SEQ ID NO: 191 - DNA, 1821 bp, Homo sapiens; identical to SEQ ID NO: 86

SEQ ID NO: 192 - DNA, 1809 bp, Homo sapiens; identical to SEQ ID NO: 87

SEQ ID NO: 193 - DNA, 1797 bp, Homo sapiens; identical to SEQ ID NO: 88

SEQ ID NO: 194 - DNA, 1794 bp, Homo sapiens; identical to SEQ ID NO: 89

SEQ ID NO: 195 - DNA, 1779 bp, Homo sapiens; identical to SEQ ID NO: 90

SEQ ID NO: 196 - DNA, 1761 bp, Homo sapiens; identical to SEQ ID NO: 91

SEQ ID NO: 197 - protein, 374 aa, Homo sapiens; identical to SEQ ID NO: 92

SEQ ID NO: 198 - protein, 606 aa, Homo sapiens; identical to SEQ ID NO: 96

SEQ ID NO: 199 - protein, 602 aa, Homo sapiens; identical to SEQ ID NO: 97

SEQ ID NO: 200 - protein, 598 aa, Homo sapiens; identical to SEQ ID NO: 98

SEQ ID NO: 201 - protein, 597 aa, Homo sapiens; identical to SEQ ID NO: 99

SEQ ID NO: 202 - protein, 592 aa, Homo sapiens; identical to SEQ ID NO: 100

SEQ ID NO: 203 - protein, 587 aa, Homo sapiens; identical to SEQ ID NO: 101

SEQ ID NO: 204 - protein, 375 aa, Homo sapiens; identical to SEQ ID NO: 174

SEQ ID NO: 205 - protein, 607 aa, Homo sapiens; identical to SEQ ID NO: 177

SEQ ID NO: 206 - protein, 603 aa, Homo sapiens; identical to SEQ ID NO: 178

SEQ ID NO: 207 - protein, 599 aa, Homo sapiens; identical to SEQ ID NO: 179

SEQ ID NO: 208 - protein, 598 aa, Homo sapiens; identical to SEQ ID NO: 180

SEQ ID NO: 209 - protein, 593 aa, Homo sapiens; identical to SEQ ID NO: 181

SEQ ID NO: 210 - protein, 587 aa, Homo sapiens; identical to SEQ ID NO: 182

SEQ ID NO: 211 - DNA, 1134 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggag

SEQ ID NO: 212 - DNA, 1830 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 213 - DNA, 1836 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagggatccgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 214 - DNA, 1818 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 215 - DNA, 1806 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 216 - DNA, 1803 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 217 - DNA, 1788 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 218 - DNA, 1764 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 219 - DNA, 1131 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggag

SEQ ID NO: 220 - DNA, 1827 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 221 - DNA, 1833 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagggatccgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 222 - DNA, 1815 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 223 - DNA, 1803 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 224 - DNA, 1800 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 225 - DNA, 1785 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctgagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 226 - DNA, 1770 bp, Homo sapiens
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 227 - protein, 378 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLE

SEQ ID NO: 228 - protein, 378 aa, Homo sapiens; identical to SEQ ID NO: 227

SEQ ID NO: 229 - protein, 612 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 230 - protein, 606 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 231 - protein, 602 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEIEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 232 - protein, 601 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 233 - protein, 596 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 234 - protein, 588 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 235 - protein, 377 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLE

SEQ ID NO: 236 - protein, 609 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 237 - protein, 611 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - protein, 605 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 239 - protein, 601 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEIEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 240 - protein, 600 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 241 - protein, 595 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 242 - protein, 590 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 243 - protein, 4 aa, Artificial Sequence
  Description of Artificial Sequence: Synthetic peptide
LYLE

SEQ ID NO: 244 - protein, 5 aa, Artificial Sequence
  Description of Artificial Sequence: Synthetic peptide
PLYLE

SEQ ID NO: 245 - protein, 8 aa, Artificial Sequence
  Description of Artificial Sequence: Synthetic peptide
MTSPLYLE

SEQ ID NO: 246 - protein, 10 aa, Artificial Sequence
  Description of Artificial Sequence: Synthetic peptide
AVMTSPLYLE

SEQ ID NO: 247 - protein, 9 aa, Artificial Sequence
  Description of Artificial Sequence: Synthetic peptide
VMTSPLYLE

SEQ ID NO: 248 - protein, 14 aa, Artificial Sequence
  Description of Artificial Sequence: Synthetic peptide
EERPAVMTSPLYLE

SEQ ID NO: 249 - protein, 15 aa, Artificial Sequence
  Description of Artificial Sequence: Synthetic peptide
LEERPAVMTSPLYLE

SEQ ID NO: 250 - protein, 17 aa, Artificial Sequence
  Description of Artificial Sequence: Synthetic peptide
KALEERPAVMTSPLYLE

SEQ ID NO: 251 - protein, 17 aa, Artificial Sequence
  Description of Artificial Sequence: Synthetic peptide
EALEERPAVMTSPLYLE

SEQ ID NO: 252 - protein, 21 aa, Artificial Sequence
  Description of Artificial Sequence: Synthetic peptide
RPVAKALEERPAVMTSPLYLE

SEQ ID NO: 253 - protein, 4 aa, Artificial Sequence
  Description of Artificial Sequence: Synthetic peptide
DYLE

SEQ ID NO: 254 - protein, 5 aa, Artificial Sequence
  Description of Artificial Sequence: Synthetic peptide
PDYLE

SEQ ID NO: 255 - protein, 8 aa, Artificial Sequence
  Description of Artificial Sequence: Synthetic peptide
TASPDYLE

SEQ ID NO: 256 - protein, 9 aa, Artificial Sequence
  Description of Artificial Sequence: Synthetic peptide
ITASPDYLE

SEQ ID NO: 257 - protein, 10 aa, Artificial Sequence
  Description of Artificial Sequence: Synthetic peptide
EITASPDYLE

SEQ ID NO: 258 - protein, 14 aa, Artificial Sequence
  Description of Artificial Sequence: Synthetic peptide
GREKEITASPDYLE

SEQ ID NO: 259 - protein, 15 aa, Artificial Sequence
  Description of Artificial Sequence: Synthetic peptide
PGREKEITASPDYLE

SEQ ID NO: 260 - protein, 16 aa, Artificial Sequence
  Description of Artificial Sequence: Synthetic peptide
APGREKEITASPDYLE

SEQ ID NO: 261 - protein, 17 aa, Artificial Sequence
  Description of Artificial Sequence: Synthetic peptide
PAPGREKEITASPDYLE

SEQ ID NO: 262 - protein, 17 aa, Artificial Sequence
  Description of Artificial Sequence: Synthetic peptide
QAPGREKEITASPDYLE

SEQ ID NO: 263 - protein, 20 aa, Artificial Sequence
  Description of Artificial Sequence: Synthetic peptide
PKQQAPGREKEITASPDYLE

SEQ ID NO: 264 - protein, 4 aa, Artificial Sequence
  Description of Artificial Sequence: Synthetic peptide
VYAG

SEQ ID NO: 265 - protein, 5 aa, Artificial Sequence
  Description of Artificial Sequence: Synthetic peptide
SVYAG

SEQ ID NO: 266 - protein, 8 aa, Artificial Sequence
  Description of Artificial Sequence: Synthetic peptide
EAGSVYAG

SEQ ID NO: 267 - protein, 9 aa, Artificial Sequence
  Description of Artificial Sequence: Synthetic peptide
DEAGSVYAG

SEQ ID NO: 268 - protein, 10 aa, Artificial Sequence
  Description of Artificial Sequence: Synthetic peptide
ADEAGSVYAG

SEQ ID NO: 269 - protein, 14 aa, Artificial Sequence
  Description of Artificial Sequence: Synthetic peptide
ELVEADEAGSVYAG

SEQ ID NO: 270 - protein, 15 aa, Artificial Sequence
  Description of Artificial Sequence: Synthetic peptide
EELVEADEAGSVYAG

SEQ ID NO: 271 - protein, 17 aa, Artificial Sequence
  Description of Artificial Sequence: Synthetic peptide
AEEELVEADEAGSVYAG

SEQ ID NO: 272 - protein, 18 aa, Artificial Sequence
  Description of Artificial Sequence: Synthetic peptide
PAEEELVEADEAGSVYAG

SEQ ID NO: 273 - protein, 21 aa, Artificial Sequence
  Description of Artificial Sequence: Synthetic peptide
GPRAAEEELVEADEAGSVYAG

SEQ ID NO: 274 - protein, 4 aa, Artificial Sequence
  Description of Artificial Sequence: Synthetic peptide
RYTD

SEQ ID NO: 275 - protein, 5 aa, Artificial Sequence
  Description of Artificial Sequence: Synthetic peptide
ARYTD

SEQ ID NO: 276 - protein, 8 aa, Artificial Sequence
  Description of Artificial Sequence: Synthetic peptide
APEARYTD

SEQ ID NO: 277 - protein, 9 aa, Artificial Sequence
  Description of Artificial Sequence: Synthetic peptide
AAPEARYTD

SEQ ID NO: 278 - protein, 10 aa, Artificial Sequence
  Description of Artificial Sequence: Synthetic peptide
AAAPEARYTD

SEQ ID NO: 279 - protein, 14 aa, Artificial Sequence
  Description of Artificial Sequence: Synthetic peptide
PTWTAAAPEARYTD

SEQ ID NO: 280 - protein, 15 aa, Artificial Sequence
  Description of Artificial Sequence: Synthetic peptide
DPTWTAAAPEARYTD

SEQ ID NO: 281 - protein, 17 aa, Artificial Sequence
  Description of Artificial Sequence: Synthetic peptide
EEDPTWTAAAPEARYTD

SEQ ID NO: 282 - protein, 18 aa, Artificial Sequence
  Description of Artificial Sequence: Synthetic peptide
PEEDPTWTAAAPEARYTD

SEQ ID NO: 283 - protein, 90 aa, Homo sapiens
LKHVEVNGSKVGPDGTPYVTVLKSWISESVEADVRLRLANVSERDGGEYLCRATNFIGVAEKAFWLSVHGPRAAEEELVEADEAGSVYAG

SEQ ID NO: 284 - protein, 89 aa, Homo sapiens
LKHIEVNGSKIGPDNLPYVQILKHSGINSSDAEVLTLFNVTEAQSGEYVCKVSNYIGEANQSAWLTVTRPVAKALEERPAVMTSPLYLE

SEQ ID NO: 285 - protein, 31 aa, Artificial Sequence
  Description of Artificial Sequence: Synthetic peptide
ANQSAWLTVTRPVAKALEERPAVMTSPLYLE

SEQ ID NO: 286 - protein, 27 aa, Artificial Sequence
  Description of Artificial Sequence: Synthetic peptide
SHHSAWLTVLEALEERPAVMTSPLYLE

SEQ ID NO: 287 - protein, 30 aa, Artificial Sequence
  Description of Artificial Sequence: Synthetic peptide
ANQSAWLTVLPKQQAPGREKEITASPDYLE

SEQ ID NO: 288 - protein, 27 aa, Artificial Sequence
  Description of Artificial Sequence: Synthetic peptide
SFHSAWLTVLPAPGREKEITASPDYLE

SEQ ID NO: 289 - protein, 31 aa, Artificial Sequence
  Description of Artificial Sequence: Synthetic peptide
AEKAFWLSVHGPRAAEEELVEADEAGSVYAG

SEQ ID NO: 290 - protein, 28 aa, Artificial Sequence
  Description of Artificial Sequence: Synthetic peptide
SHHSAWLVVLPAEEELVEADEAGSVYAG

SEQ ID NO: 291 - protein, 28 aa, Artificial Sequence
  Description of Artificial Sequence: Synthetic peptide
SYQSAWLTVLPEEDPTWTAAAPEARYTD

SEQ ID NO: 292 - protein, 6 aa, Artificial Sequence
  Description of Artificial Sequence: Synthetic peptide
LYLEGS

SEQ ID NO: 293 - protein, 10 aa, Artificial Sequence
  Description of Artificial Sequence: Synthetic peptide
MTSPLYLEGS

SEQ ID NO: 294 - protein, 11 aa, Artificial Sequence
  Description of Artificial Sequence: Synthetic peptide
VMTSPLYLEGS

SEQ ID NO: 295 - protein, 16 aa, Artificial Sequence
  Description of Artificial Sequence: Synthetic peptide
EERPAVMTSPLYLEGS

SEQ ID NO: 296 - protein, 21 aa, Artificial Sequence
  Description of Artificial Sequence: Synthetic peptide
VLEALEERPAVMTSPLYLEGS

SEQ ID NO: 297 - protein, 6 aa, Artificial Sequence
  Description of Artificial Sequence: Synthetic peptide
VYAGGS

SEQ ID NO: 298 - protein, 10 aa, Artificial Sequence
  Description of Artificial Sequence: Synthetic peptide
EAGSVYAGGS

SEQ ID NO: 299 - protein, 11 aa, Artificial Sequence
  Description of Artificial Sequence: Synthetic peptide
DEAGSVYAGGS

SEQ ID NO: 300 - protein, 16 aa, Artificial Sequence
  Description of Artificial Sequence: Synthetic peptide
ELVEADEAGSVYAGGS

SEQ ID NO: 301 - protein, 22 aa, Artificial Sequence
  Description of Artificial Sequence: Synthetic peptide
VLPAEEELVEADEAGSVYAGGS

SEQ ID NO: 302 - protein, 13 aa, Artificial Sequence
  Description of Artificial Sequence: Synthetic peptide
ERPAVMTSPLYLE

SEQ ID NO: 303 - protein, 19 aa, Artificial Sequence
  Description of Artificial Sequence: Synthetic peptide
VLEALEERPAVMTSPLYLE

SEQ ID NO: 304 - protein, 13 aa, Artificial Sequence
  Description of Artificial Sequence: Synthetic peptide
LVEADEAGSVYAG

SEQ ID NO: 305 - protein, 20 aa, Artificial Sequence
  Description of Artificial Sequence: Synthetic peptide
VLPAEEELVEADEAGSVYAG

SEQ ID NO: 306 - protein, 13 aa, Artificial Sequence
  Description of Artificial Sequence: Synthetic peptide
REKEITASPDYLE

SEQ ID NO: 307 - protein, 22 aa, Artificial Sequence
  Description of Artificial Sequence: Synthetic peptide
VLPKQQAPGREKEITASPDYLE

SEQ ID NO: 308 - protein, 19 aa, Artificial Sequence
  Description of Artificial Sequence: Synthetic peptide
VLPAPGREKEITASPDYLE

The invention claimed is:

1. An FGFR1 fusion protein comprising an extracellular domain of an FGFR1 polypeptide and a fusion partner, wherein the extracellular domain consists of amino acids 22 to 360 of SEQ ID NO: 130.

2. The FGFR1 fusion protein of claim 1, wherein the fusion partner is an Fc polypeptide.

3. An FGFR1 fusion protein consisting of amino acids 22 to 592 of SEQ ID NO: 100.

* * * * *